US008476200B2

(12) United States Patent
Russwurm et al.

(10) Patent No.: US 8,476,200 B2
(45) Date of Patent: Jul. 2, 2013

(54) METHOD FOR DIFFERENTIATING BETWEEN THE NON-INFECTIOUS AND INFECTIOUS CAUSES OF MULTIPLE ORGAN FAILURE

(75) Inventors: Stefan Russwurm, Jena (DE); Konrad Reinhart, Jena (DE)

(73) Assignee: SIRS-Lab GmbH, Jena (DE)

( * ) Notice: Subject to any disclaimer, the term of this patent is extended or adjusted under 35 U.S.C. 154(b) by 942 days.

(21) Appl. No.: 11/577,102

(22) PCT Filed: Aug. 18, 2005

(86) PCT No.: PCT/EP2005/008969
§ 371 (c)(1),
(2), (4) Date: Nov. 24, 2008

(87) PCT Pub. No.: WO2006/042581
PCT Pub. Date: Apr. 27, 2006

(65) Prior Publication Data
US 2009/0075831 A1    Mar. 19, 2009

(30) Foreign Application Priority Data
Oct. 13, 2004    (DE) .......................... 10 2004 049 897

(51) Int. Cl.
*C12Q 1/68*    (2006.01)
(52) U.S. Cl.
USPC ........................................................... 506/9
(58) Field of Classification Search
None
See application file for complete search history.

(56) References Cited

U.S. PATENT DOCUMENTS

| 5,830,679 A | 11/1998 | Bianchi et al. |
| 2001/0051344 A1 | 12/2001 | Shalon et al. |
| 2002/0164656 A1 | 11/2002 | Hoeffler |
| 2003/0194752 A1 | 10/2003 | Anderson et al. |
| 2004/0096917 A1 | 5/2004 | Ivey et al. |
| 2004/0106142 A1 | 6/2004 | Ivey et al. |
| 2005/0228172 A9* | 10/2005 | Wang ........................... 536/24.3 |
| 2006/0134685 A1 | 6/2006 | Zipfel et al. |
| 2008/0070235 A1 | 3/2008 | Russwurm et al. |
| 2008/0286763 A1 | 11/2008 | Russwurm |
| 2009/0325152 A1 | 12/2009 | Russwurm et al. |
| 2011/0076685 A1* | 3/2011 | Moeller et al. ..................... 435/6 |

FOREIGN PATENT DOCUMENTS

| DE | 10041215 A1 | 10/2001 |
| EP | 1270740 A1 | 1/2003 |
| WO | WO 99/40434 A1 | 8/1999 |
| WO | 03002763 A1 | 1/2003 |
| WO | WO 03/002763 A1 | 1/2003 |
| WO | WO 2004/031412 A2 | 4/2004 |
| WO | 2004043236 A2 | 5/2004 |
| WO | WO 2004/067778 A2 | 8/2004 |
| WO | WO 2004/087949 A2 | 10/2004 |
| WO | WO2004087949 * | 10/2004 |

OTHER PUBLICATIONS

Gitig, Diana (Genetic Engineering and Biotechnology New, vol. 31, No. 20, pp. 1-3, Nov. 2011).*
Cheung, Nature Genetics 2003, vol. 33, p. 422-425.*
Thisted,pp. 1-6. Ronald A. et al.: "What is a P-value?", (1998) available from http:l/www.stat.uchicago.edu/thisted, printed.*
Cobb et al. (2004, Crit Care Med, 2002, 30(12):2711-2721).*
Feezor et al (Clinical Infectious Diseases, 2005, vol. 41, pp. S427-S435).*
Gitig, Diana (Genetic Engineering and Biotechnology New, vol. 31, No. 20, pp. 1-3, Nov. 2011.*
Bonaldo et al. (Gen Res., 1996, 6, p. 791-806).*
Office Action in corresponding chinese application procedure.
Enard et al. (Science 2002 vol. 296 p. 340).
Wu (Journal of pathology 2001 vol. 195 p. 53).
Newton et al (Journal of Computational Biology 2001 vol. 8 p. 37).
Hynninen et al. (Shock 2003 vol. 20 p. 1).
Perry et al. (Intensive Care Med 2003 Vo. 29 p. 1245).
Riedemann et al. (Journal of Clinical Investigation Jul. 2002 vol. 110 p. 101).
Tulzo et al. "Early Circulating Lymphocyte Adoptosis in Human Septic Shock is Associated With Poor Outcome" Shock 2002, vol. 18, p. 487-494.
Freezor et al., Clinical Infectious Disease, vol. 41, S427-S435, Sep. 2005.
Gitig, Diana, Genetic Engineering & Biotechnology News, vol. 31, No. 20, pp. 1-3, Nov. 15, 2011.
Van De Vijver, M.J. et al.: "A gene-expression signature as a predictor of survival in breast cancer" N. Engl. J. Med (2002) 347 (25) 1999-2009.
Hoshikawa, Y. et al.: "Hypoxia induces different genes in the lungs of rats compared with mice", Physiol Genomics (2003) 12 : 209-219.
Cheung, V.G. et al.: "Natural variation in human gene expression assessed in lymphoblastoid cells", Nature Genetics (2003), vol. 33, pp. 422-425.
Thisted, Ronald A. et al.: "What is a P-value?", (1998) available from http://www.stat.uchicago.edu/thisted, printed pp. 1-6.
Database NETAFFX, Mar. 15, 2006, http://www.affymetrix.com/analysis/netaffx/probematch/probe_match.affx?netaffx=netaffx4_annot.
Ray, Arghya et al.: "Peptide nucleic acid (PNA): its medical and biotechnical applications and promise for the future", Department of Physical Chemistry, Chalmers University of Technology, S 412 96 Gothenburg, 2000, Medical and Biotechnical Applications of PNA, 14:1041-1060.

(Continued)

*Primary Examiner* — Stephanie K Mummert
(74) *Attorney, Agent, or Firm* — Patent Central LLC; Stephan A. Pendorf

(57) ABSTRACT

The present invention relates to the use of gene expression profiles obtained in vitro from patient samples for differentiating between the non-infectious and infectious causes of multiple organ failure. The invention also relates to a method for measuring gene expression profiles in vitro and the use of said gene expression profiles and/or of the probes used therein for screening active substances against the non-infectious and/or infectious causes of multiple organ failure.

20 Claims, No Drawings

OTHER PUBLICATIONS

Jansen, Burkhard et al.: "Antisense therapy for cancer—the time of truth", Nov. 2002, The Lancet Oncology, 3:672-683.
Galderisi, Umberto et al.: "Antisense Oligonucleotides as Therapeutic Agents", 1999, Journal of Cellular Physiology, 181:251-257.
Riesewijk, Anne at al.: "Gene expression profiling of human endometrial receptivity on days LH+2 versus LH+7 by microarray technology", 2003, 9(5):253-264.
Liu, Zheng et al.: "Gene expression profiles in human nasal polyp tissues studied by means of DNA microarray", 2004, 114(4):783-790.
Cobb, J. Perren. Crit Care Med 2002 vol. 30, No. 12. p. 2711-2721.
"Details for HG-U95AV2:2024_S_AT" Internet Citation [Online], Oct. 1, 2004, pp. 1-3, XP007907827, found on the internet: URL: https://www.affymetrix.com/analysis/netaffx/fullrecord.affx?pk= H>, found on Mar. 20, 2009.
Haslinger, Christian et al.: "Microarray Gene Expression Profiling of B-Cell Chronic Lymphocytic Leukemia Subgroups Defined by Genomic Aberrations and VH Mutation Status", Journal of Clinical Oncology, American Society of Clinical Oncology, US, Bd. 22, Nr. 19, Oct. 1, 2004, pp. 3937-3949, XP009114229.*Summary*. *p. 3938, right column.*.
Japanese Office Action and English Translation Thereof, Apr. 26, 2011.
"Method of Measuring Procalcitonin" Examination and Technology 2002, vol. 30, No. 7, pp. 569-570.
Cobb, et al. "Sepsis Gene Expression Profiling: Murine Splenic Compared With Hepatic Responses Determined by Using Complementary DNA Microarrays" Crit. Care Med., 2002, vol. 30, pp. 2711-2721.
Liu, et al. "Gene Expression Profiles in Human Nasal Polyp Tissues Studied by Means of DNA Microarray" J. Allergy Clin. Immunol., 2004, vol. 114, pp. 783-790.
Natanson, et al., "Anti-inflammatory Therapies to Treat Sepsis and Septic Shock: A Reassessment," Natl. Inst. Health, Bethesda, MD. (1997).
Knaus et al., "Prognosis in Acute Organ-System Failure," The George Washington University Medical Center, Washington, DC, 685-693, Dec. 1985.
Alizadeh, "Distinct Types of Diffuse Large B-Cell Lymphoma Identified by Gene Expression Profiling," Nature, 403: 503-511 (2000).
American College of Chest Physicians/Society of Critical Care Medicine Consensus Conference: Definitions for Sepsis and Organ Failure and Guidelines for the use of Innovative Therapies in Sepsis, Crit. Care Med., 20:6, 864-874 (1992).
Bernardin et al., "Blood Pressure and Arterial Lactate Level are Early Indicators of Short-Term Survival in Human Septic Shock," Intensive Care Med., 22: 17-25 (1996).
Feezor et al., "Genomic and Proteomic Determinants of Outcome in Patients Undergoing Thoracoabdominal Aortic Aneurysm Repair," J. of Immun., 172: 7103-109 (2004).
Duswald et al., "Released Granulocytic Elastawe: An Indicator of Pathobiochemical Alterations in Septicemia after Abdominal Surgery," Surgery, 892-899, 1985.
Fodor et al., Light-Directed, Spatially Addressable Parallel Chemical Synthesis, Science, 251: 767-773 (1991).
Gillespie et al., "A Quantitative Assay for DNA-RNA Hybrids with DNA Immobilized on a Membrane," J. Mol. Biol., 12: 829-842 (1965).
Golub, "Molecular Classification of Cancer: Class Discovery and Class Prediction by Gene Expression Monitoring," Science, 286 : 531-537 (1999).
Goris et al., "Multiple-Organ Failure," Arch. Surg., 120: 1109-1115 (1985).
Hack et al., "Increased Plasma Levels of Interleukin-6 in Sepsis," Blood, 74:5,1704-1710 (1989).
Huber et al., "Parameter Estimation for the Calibration and Variance Stabilization of Microarray Data," Statistical Applications in Genetics & Molecular Biology, 2:1, Article 3, 1-22 (2003).
Kafatos et al., "Determination of Nucleic Acid Sequence Homologies and Relative Concentrations by a Dot Hybridization Procedure," Nucleic Acids Research, 7:6, 1541-1552 (1979).
Lennon et al., Hybridization of Arrayed cDNA Libraries, TIG, 7:10, 314-317 (1991).
Levy et al., "2001 SCCM/ESICM/ACCP/ATS/SIS International Sepsis Definitions Conference," Crit. Care Med., 31:4, 1250-1256 (2003).
Livingston et al., "Multiple Organ Failure: A Common Problem in Surgical Intensive Care Unit Patients," Ann. Med., 27: 13-20 (1995).
Marecaux et al., "Blood Lactate Levels are Better prognostic Indicators than TNF and IL-6 Levels in Patients with Septic Shock," Intensive Care Med., 22: 404-408 (1996).
Marik, "Gastric Intramucosal pH. A Better Predictor of Multi Organ Dysfunction Syndrome and Death than Oxygen-Derived Variables in Patients with Sepsis," Chest, 104: 225-29 (1993).
Nuytinck et al., "Posttraumatic Complications and Inflammatory Mediators," Arch. Surg., 121: 886-890 (1986).
Patel et al., "Interleukin 6 is a Prognostic Indicator of Outcome in Severe Intra-Abdominal Sepsis," British J. of Surgery, 8: 1306-08 (1994).
Pease et al., "Light-Generated Oligonucleotide Arrays for Rapid DNA Sequence Analysis," Proc. Nat'l Acad. Sci., 91: 5022-26 (1994).
Schena et al., "Quantitative Monitoring of Gene Expression Patterns with a Complementary DNA Microarray," Science, 270: 467-470 (1995).
Schlag, et al., Introduction: "Organ in Shock", "Early Organ Failure", "Late Organ Failure," Pathophysiology of Shock, Sepsis, and Organ Failure, Springer-Verlag, 1-3 (1993).
Southern, EM, "An Improved Method for Transferring Nucleotides from Electrophoresis Strips to Thin Layers of Ion-Exchange Cellulose," Anal. Chem., 62: 317-8 (1974).
Vincent, "Prevention and Therapy of Multiple Organ Failure," World J. Surg., 20: 465-470 (1996).
Vincent et al., "The SOFA (Sepsis-Related Organ Failure Assessment) Score to Describe Organ Dysfunction/Failure," Intensive Care Med., 22: 707-710 (1996).
Chinnaiyan, et al., "Molecular Signatures of Sepsis, Multiorgan Gene Expression Profiles of Systemic Inflammation", American Journal of Pathology, 159:4, 1199-1209 (2001).
Yu, et al., "Differential gene expression in gram-negative and gram-positive sepsis", Am J Respir Crit Care Med 169:10, 1135-43 (2004).
Schlag, G., et al., "The cell in shock: the origin of multiple organ failure", Resuscitation 21:2-3, 137-80 (1991).
Database EMBL *Homo sapiens* cDNA clone, Jan. 13, 1996, XP002412098, gefunden im EBI, Database accession No. N32857, Zusammenfassung.
Database EMBL *Homo sapiens* cDNA clone, Jan. 13, 1996, XP002412099, gefunden im EBI, Database accession No. N32853, Zusammenfassung.
Database EMBL *Homo sapiens* cDNA clone, Jan. 13, 1996, XP002412100, gefunden im EBI, Database accession No. N32495, Zusammenfassung.
Database EMBL *Homo sapiens* cDNA clone, Jun. 4, 1999, XP002412101, gefunden im EBI, Database accession No. AI701077, Zusammenfassung.
Database EMBL Human Anti-Hepatitis A Ig Lambda Chain 10, Mar. 10, 1992, XP002412102, gefunden im EBI, Database accession No. M87790, Zusammenfassung.
Database EMBL *Homo sapiens* cDNA clone, Mar. 25, 1999, XP002412103, gefunden im EBI, Database accession No. AI559317, Zusammenfassung.
Database EMBL *Homo sapiens* cDNA clone, Jan. 19, 1996, XP002412104, gefunden im EBI, Database accession No. N34897, Zusammenfassung.
Database EMBL *Homo sapiens* cDNA clone, Apr. 14, 1998, XP002412105, gefunden im EBI, Database accession No. AA907084, Zusammenfassung.
Database EMBL *Homo sapiens* cDNA clone, Feb. 17, 1996, XP002412106, gefunden im EBI, Database accession No. N45223, Zusammenfassung.
Cobb, et al., "Sepsis gene expression profiling; Murine splenic compared with hepatic responses determined by using complimentary DNA microarrays," Crit Care Med 30:12, 2711-2 (2002).

Tsukahara, et al., "Gene Expression in Human Neutrophils During Activation and Priming by Bacterial Lipopolysaccharide", Journal of Cellular Biochemistry, 89:848-861 (2003).

Deigner, 6$^{th}$ World Congress on Trauma, Shock, Inflammation & Sepsis? Pathophysiology, XP002327554, www.sirs lab.de/content/de/pdf/kompetenzen/deinger, (2005).

Pathan, et al., "The Complexity of the Inflammatory Response to Meningococcal Sepsis Revealed by Gene Expression . . .", Crit Care Med, 30:12 Suppl. (2002).

Mira, et al., "Association of TNF2, a TNF-α Promoter Polymorphism, with Septic Shock Susceptibility and Mortality", JAMA 208:6, 561-8 (1999).

Barriere, et al., "An overview of mortality risk prediction in sepsis", Crit Care Med, 23:2, 376-393 (1995).

Botwell, David, D. L., "Options available—from start to finish—for obtaining expression data by microarray", Nature Genetics Supplement, 21: 25-32 (1999).

Prucha, et al., "Expression Profiling: Toward an Application in Sepsis Diagnostics", Shock, 22:1 29-33 (2004).

Weigand, et al., "Gene Expression Pattern in Human Monocytes as a Surrogate Marker for Systemic Inflammatory Response Syndrome (SIRS)", Molecular Medicine, 5:192-202 (1999).

Rowe, et al., "An Array of Immunosensor for Simultaneous Detection of Clinical Analysis," Anal. Chem. 71:433-39 (1999).

Oberhoffer, et al., "Discriminative power of inflammatory markers for prediction of tumor necrosis . . .," Intensive Care Med, 26:S170-S174 (2000).

Database EMBL *Homo sapiens* (clone KT2) Bone Morphogenetic Protein-1 (BMP-1) mRNA & Alternatively Spliced . . . , XP0023073 Database accession No. L35279, Zusammenfassung (1995).

Heller, et al., "Discovery and analysis of inflammatory disease-related genes using cDNA microarrays", Proc. Natl. Acad, Sci USA, 94: 2150-55 (1997).

Pfeiffer, et al., "Endotoxinamie . . . (endotoxemia and multiple organ failure upon polytrauma)," Anaesthesiol Reanimat, 21: 91-96 (1996).

Bone, et al., "The ACCP/SCCM . . . Definitions for sepsis and organ failure and guidelines for the use of innovative therapies . . . ," Chest 101:1656-1662, Crit Care Med, 20:864-874, 1992.

http://chirinn.klinikum.uni-muenchen.de/forschung/for_01_14_04.html, as of Oct. 2004, modifed.

Nast-Kolb, et al., Die Wertigkeit . . . (Valence of biomendial factors with polytrauma), Hefte Unfallheilkunde, 215 (1991).

Natanson, C., "Anti-inflammatory therapies to treat sepsis and septic shock" A reassessment, Crit Care Med, 25: 1095-1099, Jul. 1997.

Geiger, K., "Fruhparameter fur Multiorgandysfunktionssyndrom (early parameters for multiple organ dysfunction syndrome)," Sepsis in der Fruhphase . . . Medizin Verlag 19-25 (1995).

Office Action in corresponding chinese application procedure, Dec. 18, 2009.

EMBL N32857, Publication Date: Jan. 13, 1996.
EMBL N32853, Publication Date: Jan. 13, 1996.
EMBL N32495, Publication Date: Jan. 13, 1996.
EMBL A1701077, Publication Date: Jun. 4, 1999.
EMBL M87790, Publication Date: Mar. 10, 1992.
EMBL A1559317, Publication Date: Mar. 25, 1999.
EMBL N34897, Publication Date: Jan. 19, 1996.
EMBL AA907084, Publication Date: Apr. 14, 1998.
EMBL N45223, Publication Date: Feb. 17, 1996.

Ko, J.L., et al., "Molecular cloning and expression of a fungal immunomodulatory protein, FIP-fve, from Flammulina . . . ," J. of the Formosan Med Assoc. 96:7 517-524 (1997).

Liu, Z., et al., "Gene expression profiles in human nasal polyp tissues studied by means of DNA microarray," J. of Allergy and Clinical Immunology, 114: 4, 783-90 (2004).

Database NETAFIX, "www.affymetrix.com/analysis/netaffx/probematch/probe_match.affx?netaffx=netaffx4_annot" (2006).

Riesewijk, et al., "Gene expression profiling of human endometrial receptivity on days LH+2 versus LH+7 by microarray technology," Mol Human Reprod, 9:5 253-264 (2003).

Lü, Y. et al. "Analysis of the poly-genes expression changes in liver by gene expression profile chip in gut ischemia-reperfusion rats" Zhonggui Wei Zhong Bing Ji Jiu Yi Xue, Feb. 2003;15(2)84-7 www.ncbi.nim.nih.gov.

Liao, JK et al. "Change of nuclear factor-kappaB activity in early burn injury and its significance" Zhonggui Wei Zhong Bing Ji Jiu Yi Xue, Apr. 2003 15 (4) 220-1 www.ncbi.nim.nih.gov.

Power, C. et al. "Proinflammatory Effects of Bacterial Lipoprotein on Human Neutrophil Activation Status, Function and Cytotoxic Potential In Vitro" Shock, 2001, vol. 15, No. 6, pp. 461-466.

* cited by examiner

METHOD FOR DIFFERENTIATING BETWEEN THE NON-INFECTIOUS AND INFECTIOUS CAUSES OF MULTIPLE ORGAN FAILURE

The present invention relates to the use of gene expression profiles obtained in vitro from a patient sample for differentiating between the non-infectious and infectious causes of multiple organ failure, a method for measuring such gene expression profiles in vitro, as well as the use of gene expression profiles and/or of the probes used therein for switching off and/or changing activity of target genes and/or detecting gene activity for screening active substances against non-infectious/infectious multiple organ failure and/or for assessing therapeutic effects of active substances for non-infectious/infectious multiple organ failure.

The present invention further relates to new possibilities of differentiating between non-infectious and infectious causes of multiple organ failure of patients, which can be derived from experimentally verified insights in conjunction with the occurrence of changes in gene activity (transcription) in patients with multiple organ failure.

Despite advances in pathophysiological understanding and the supportive treatment, the multiple organ failure syndrome (MOFS) and multiple organ failure (MOF), respectively, is the most frequent cause of death in patients in intensive care and is continuously increasing worldwide. The consequences of this development are not only considerable to the individual patient but they also have enormous effects on the costs of the public health care systems and the medical progress in many fields of medicine.

Multiple organ failure is defined as the failure of two or more vital organ systems occurring simultaneously or within a short time period. The multiple organ failure syndrome (MOFS) precedes the MOF as initial organ insufficiency [1]. Today's definition of multiple organ failure is the dysfunction of two or more organs occurring simultaneously or within a short period of time, whereas a chronically persistent organ failure can be ruled out [2]. The prognosis of MOF is closely related to the number of the involved organ systems. If one organ fails, the mortality rate within 24 hours is 22%; after 7 days it is 41%. In the case of failure of three organ systems, the mortality increases on the first day to 80% and after 4 days to 100% [3].

For the clinical scoring of the degree of severity in MOFS and MOF, the multiple organ failure score (MOF-score) of GORIS et al. [4] or, alternatively, the sepsis related organ failure assessment (SOFA) score are routinely used [5]. The MOF score renders a quick and clinically simple classification of the organ function in three grades possible. In the clinical literature, a MOF score>4 is routinely described as MOF [6]. SOFA score is a point system quickly scoring the clinical assessment of the function of the following organ systems: respiration (lung), coagulation, liver, cardiovascular system, central nervous system and kidney. Four grades are used in this scoring system.

Clinically, the MOF runs in three stages [7]:
1. Organ in shock: The triggering pathophysiological mechanism is a perfusion deficiency of very different genesis. This happens within hours and does not yet lead to permanent damages.
2. Organ dysfunction: If the persistent perfusion deficit persists for the next few days, this will lead to the development of SIRS (Systemic Inflammatory Response Syndrome, classified according to [8]) with local oedema and cell damages. This stage is called multiple organ dysfunction syndrome (MODS).
3. Organ failure: The persistent perfusion deficit leads to stasis in the splanchnic area which leads to a superinfection and translocation of endotoxins from the intestines. This leads to a potentiation of the clinical symptoms and to the complete picture of the sepsis. The organ dysfunction becomes an organ failure.

MODS and MOF are clinical pictures with a complex pathophysiology. The exact molecular causes for the development and the complexity of the immunological-inflammatory host response to severe infection and trauma that MODS and MOF can be both of infectiologic and non-infectiologic genesis. MODS and MOF routinely develop as a clinical important complication in patients with sepsis, after a shock that was caused by trauma, with patients after surgeries where the heart-lung machine was used, after organ transplantation, and others. An important pathogenetic mechanism for the development of MODS and MOF is the development of a systemic inflammatory syndrome (SIRS, [8]). The pathophysiological processes initiated in connection with SIRS do not only involve all components of the immune system, but interfere with all levels of the cardiocirculatory system and are not restricted to myocardial depression and vasodilation. The cardiocirculatory changes in particular on the microcirculation level form the common final distance and result in a tissue hypoxia which is considered an important cofactor in the pathogenesis of multiple organ failure.

MODS and MOF can be both of infectiologic and non-infectiologic genesis. MODS and MOF routinely develop as a clinical important complication in patients with sepsis, after a shock that was caused by trauma, with patients after surgeries where the heart-lung machine was used, after organ transplantation, and others (FIG. 1). An important pathogenetic mechanism for the development of MODS and MOF is the development of a systemic inflammatory syndrome (SIRS, [8]). The pathophysiological processes initiated in connection with SIRS do not only involve all components of the immune system, but interfere with all levels of the cardiocirculatory system and are not restricted to myocardial depression and vasodilation. The cardiocirculatory changes in particular on the microcirculation level form the common final distance and result in a tissue hypoxia which is considered an important cofactor in the pathogenesis of multiple organ failure.

By today's standards, the most important mechanisms of the development of MODS and MOF [10]: It seems that an overactive immune system plays a decisive role in the development of multiple organ failure. In this context, the endothelium plays a central key role by secretion of cytokines and by imparting leukocyte adhesion. Signal transduction cascades are activated in the endothelial cells leading to the expression and activation of transcription factors.

The reason why there is still no sensitive/specific diagnostic being able to differentiate between infectious and non-infectious causes is the still incomplete knowledge of the early stage processes in MODS and MOF. New types of biomarkers and diagnostics, now even on a gene expression level, may provide the essential diagnostic information for early diagnosis of multiple organ failure as well as for the differentiation between infectious and non-infectious causes of MODS and MOF. Additionally, they are important in contributing to the clarification of the pathophysiologic mechanisms of systemic inflammations.

The precursory symptoms that are often used in clinical practice, as fever, leucocytosis, tachycardia and tachypnea are completely unspecific for the diagnosis of MODS or MOF as well as for differentiating between infectious and non-infectious causes of MODS and MOF. Parameters detecting irregularities in microcirculations at an early stage, as for example changes in the pH of the intestinal mucosa [11] and lactate level in the capillary bed [12, 13], emerging of a respiratory insufficiency the cause of which is not in the lung [2], the ascent of the leucocyte elastase [14, 15], the height of the neopterine level [16], the activation of polymorphnuclear leucocytes and the height of the IL-6-level [17] are suitable as early parameters for the later development of MODS and MOF only to a limited extend, but they cannot contribute to the differentiation between infectious and non-infectious causes of MODS and MOF. Thus, there is urgent need for novel diagnostic methods for improving the capacity of the person skilled in the art to differentiate at an early stage between non-infectious and infectious MODS or MOF and to make predictions on how the patient will respond to specific treatments.

However, it is exactly the differentiation between infectious and non-infectious causes of MODS and MOF which is of utmost medicinal importance, as for example antibiotics may be used more efficiently with this differentiation, this contributing to considerable cost savings as well as to the avoidance of side effects caused by the unspecific application of antibiotics. In the case of non-infectious MODS or MOF it is, additionally, possible to avoid time and people-intensive diagnostic measures that are very stressful for the patient (e.g. transport to CT/MRI) for identification of the respective site of infection, the realisation of comprehensive microbiological methods (e.g. examination of blood cultures for which the patient also must deliver great amounts of blood) but also the risky exchange of all plastics material connected with the patient, such as venous catheter, etc. Vice versa, the quick identification of infectious causes of MODS or MOF can ensure that these measures are taken quickly and mortality can, therefore, be reduced.

Technological advances, in particular the development of microarray technology, make it now possible for the person skilled in the art to simultaneously compare 10 000 or more genes and their gene products. The use of such microarray technologies can now provide information regarding the status of health, regulatory mechanisms, biochemical interactions and signal transmitter networks. As the comprehension how an organism reacts to infections is improved this way, this should faciliate the development of enhanced modalities of detection, diagnosis and therapy of sepsis disorders.

Microarrays have their origin in "Southern blotting" [19], which represented the first approach to immobilizing DNA-molecules so that it can be addressed three-dimensionally on a solid matrix. The first micro arrays consisted of DNA-fragments, frequently with unknown sequence, and were applied dotwise onto a porous membrane (normally nylon). Routinely, cDNA, genomic DNA or plasmid libraries were employed and the hybridized material was labelled with a radioactive group [20-22].

Recently, the use of glass as substrate and fluorescence for detection together with the development of new technologies for the synthesis and for the application of nucleic acids in very high densities made it possible to miniaturize the nucleic acid arrays. At the same time, the experimental throughput and the information content were increased [23-25].

Further, it is known from WO 03/002763 that microarrays basically can be used for the diagnosis of sepsis and sepsis-like conditions.

The first explanation for the applicability of microarray technology was obtained through clinical trials in the field of cancer research. Here, expression profiles proofed to be valuable with regard to identification of activities of individual genes or groups of genes, which correlate with certain clinical phenotypes [26]. Many samples of individuals with or without acute leukaemia or diffuse B-cell lymphoma were analyzed and gene expression labels (RNA) were found and subsequently employed for the clinically relevant classification of these types of cancer [26,27]. Golub et al. found out that an individual gene is not enough to make reliable predictions, while, however, predictions based on the change in transcription of 53 genes (selected from more than 6000 genes, which were present on the arrays) are highly accurate [26].

Alisadeh et al. [27] examined large B-cell lymphomas (DLBCL). Expression profiles were worked up by the authors with a "lympochip", a microarray bearing 18 000 clones of complementary DNA that was developed to monitor genes that are involved in normal and abnormal development of lymphocytes. By using cluster analysis, they managed to classify DLBCL in two categories that showed great differences with regard to the survival chance of patients. The gene expression profiles of these subtypes correlated to two significant stages of the B-cell differentiation.

The Applicant's German patent applications DE 103 40 395.7, DE 103 36 511.7, DE 103 150 31.5 and 10 2004 009 952.9 which have not yet been prepublished, describe that gene expression profiles are, in principle, usable, for example by means of microarray technology for the diagnosis of SIRS, generalised inflammatory inflammations, sepsis and severe sepsis. These applications are herein incorporated by reference.

It is known from Feezor et al. [28] that the gene activities of patients who developed SIRS with multiple organ dysfunction syndrome (MODS) as a consequence of their surgical treatment differ from those of patients who developed SIRS without MODS as a consequence of the same surgical treatment. However, these studies do not allow a statement on the differentiation of non-infectious MOF compared to infectious MOF, as the patients did not show an infection.

The use of gene expression profiles for the differentiation between non-infectious MOF and infectious MOF was not yet described.

The invention disclosed in the present application is basing on the perception that the gene activities of patients with non-infectious MOF differs from the gene activities of patients with infectious MOF. Thus, these differences in gene activities allow for the differentiation between infectious and non-infectious MOF by means of gene expression. The conventionally used clinical parameters do not allow such a differentiation, which, however, is very important for the initiation of a specialised therapy in intensive care.

Thus, it is the object of the present invention to differentiate between non-infectious MOF and infectious MOF by means of gene activity markers.

The present invention relates in particular to the use of gene expression profiles that have been obtained in vitro from a patient sample for the differentiation between non-infectious and infectious causes of multiple organ failure.

The present invention is further usable for assessing the course of patients suffering from non-infectious and infectious causes of multiple organ failure during therapy.

The present invention is further usable as inclusion or exclusion criterion of patients with non-infectious or infectious causes of multiple organ failure in clinical trials of the stages 2-4.

A preferred embodiment of the present invention is the creation of gene activity data for further electronic processing as well as for the production of software for the description of the individual prognosis for a sepsis patient, for diagnosis and/or patient data management systems.

The present invention may also be used for the creation of "in silico" expert systems and/or for "in silico" modulation of cellular ways of signal transfer.

For the creation of gene expression profiles according to the present invention, a majority of specific genes and/or gene fragments is used, selected from the group consisting of SEQ ID NO: 1 to SEQ ID NO: 1297, as well as gene fragments thereof with 5-2000 or more, preferably 20-200, more preferably 20-80 nucleotides.

These sequences with the SEQ ID NO: 1 to SEQ ID NO: are incorporated by the scope of the present invention and they are in detail disclosed in the enclosed sequence listing comprising 1297 sequences which is, thus, part of the description of the present invention and, therefore, also part of the disclosure of the invention. In the sequence listing the individual sequences with sequence ID No. SEQ ID NO: 1 to SEQ ID NO: 1297 are further assigned to their GenBank Accession No.

The present invention further relates to the use of gene expression profiles, which are obtained in vitro from a patient sample, and/or of probes used for this purpose, selected from the group consisting of SEQ ID NO: 1 to SEQ ID NO: 1297 as well as gene fragments thereof with at least 5-2000, preferably 20-80 nucleotides, for switching off and/or for changing the activity of target genes and/or the determination of the gene activity for the screening of active substances for non-infectious/infectious multiple organ failure and/or for assessing the effect on non-infectious/infectious multiple organ failure.

In this context, also hybridisable synthetic analogues of the listed probes may be used.

Further, the gene activities in patients suffering from non-infectious or infectious causes of multiple organ failure can be determined in clinical studies of the stages 2-4 in a biologic fluid and from this "value" conclusions may be drawn with regard to the course of disease, the chance of survival, the course of therapy or the possibility to include or exclude the sepsis patients in clinical trials.

Another embodiment of the invention is characterized in that a specific gene and/or gene fragment selected from the group consisting of SEQ ID NO: 1 to SEQ ID NO: 1297, as well as gene fragments thereof with 5-2000 or more, preferably 20-200, more preferably 20-80 nucleotides.

Another embodiment of the present invention is characterized in that at least 2 to 100 different genes and/or gene fragments are used.

Another embodiment of the present invention is characterized in that at least 200 different genes and/or gene fragments are used.

Another embodiment of the present invention is characterized in that at least 200 to 500 different genes and/or gene fragments are used.

Another embodiment of the present invention is characterized in that at least 500 to 1000 different genes and/or gene fragments are used.

Another embodiment of the present invention is characterized in that at least 1000 to 2000 different genes and/or gene fragments are used.

Another embodiment of the present invention is characterized in that the genes or gene fragments and/or the sequences derived from their RNA are replaced by synthetic analogues, aptamers, as well as peptide nucleic acids.

Another embodiment of the invention is characterized in that the synthetic analog of the genes comprise 5-100, in particular approx. 70 base pairs.

Another embodiment of the present invention is characterized in that the gene activity is determined by means of hybridisation methods.

Another embodiment of the present invention is characterized in that the gene activity is determined by means of microarrays.

Another embodiment of the invention is characterized in that the gene activity is determined by hybridisation-independent methods, in particular by enzymatic and/or chemical hydrolysis and/or amplification methods, preferably PCR, subsequent quantification of nucleic acids and/or of derivates and/or fragments of same.

Another embodiment of the present invention is characterized in that the sample is selected from: body fluids, in particular blood, liquor, urine, ascitic fluid, seminal fluid, saliva, puncture fluid, cell content, or a mixture thereof.

Another embodiment of the present invention is characterized in that cell samples are subjected a lytic treatment, if necessary, in order to free their cell contents.

It is obvious to the person skilled in the art that the individual features of the present invention shown in the claims can be combined with each other in any desired way.

The term marker genes as used in the present invention encompasses all derived DNA-sequences, partial sequences and synthetic analogues (for example peptido-nucleic acids, PNA). The description of the invention referring to the determination of the gene expression on RNA level is not supposed to be a restriction but only an exemplary application of the present invention.

The description of the invention referring to blood is only an exemplary embodiment of the present invention. The term biological liquids as used in the present invention encompasses all human body fluids.

Further advantages and features of the present invention will become apparent from the description of the embodiment as well as from the drawing.

EMBODIMENT

Differential gene expression examinations for differentiating between the non-infectious and infectious causes of multiple organ failure.

Whole blood samples of 57 patients who were under the care of a surgical intensive care unit were examined for the measurement of the differential gene expression for differentiating between non-infectious and infectious causes of multiple organ failure.

Whole blood samples of 31 patients who developed an infectious MOF [then called severe sepsis or septical shock and classified according to 8] within the care of a surgical intensive care unit.

Furthermore, whole blood samples were drawn from 26 patients who developed a non-infectious MOF [classified according to 8] within the care of a surgical intensive care unit.

As reference samples the total RNA from the cell lines SIG-M5 were used.

A range of characteristics of both patient groups is shown in table 1. In the table, information regarding age, sex, as well as the SOFA-score as measurement for the function of the organ systems is given. Likewise, the plasma protein level of procalcitonin (PCT) and CRP, the number of leucocytes as well as the most usual CDC (Center of Disease Control) criteria of the patients are indicated.

All of the patient samples were co-hybridised with the reference sample on one microarray each.

TABLE 1

Data of the group of patients

| | Patients with infectious MOF | Patients with non-infectious MOF |
|---|---|---|
| Number | 31 | 26 |
| Sex m/f | 17/14 | 15/11 |
| Age* [years] | 60 (17) | 69 (10) |
| APACHE-II-Score* [points] | 14 (10) | 14.9 (3.4) |
| SOFA-Score* [points] | 10 (3) | 8 (3) |
| Number of OD* | 3 (1) | 3 (1) |
| PCT* [ng/ml] | 3.1 (7.7) | 3.8 (6.7) |
| CRP* [µg/l] | 188 (168) | 80.2 (90.2) |
| Leucocytes* [No./l] | 13.00 (8 150) | 12.300 (6925) |
| Kind of infection according to CDC criterion | | |
| Pneumonia | 15 patients | none |
| Intraabdominal infection | 13 patients | |
| Infection of operating site without wound infection | 2 patients | |
| Infection of the gastrointestinal tract | 1 patient | |

*Median (interquartile distance)

Experimental Description:

After drawing whole blood, the total RNA of the samples was isolated using the PAXGene Blood RNA kit according to the manufacturer's (Qiagen) instructions.

Cell Cultivation

For cell cultivation (control samples) 19 cryo cell cultures (SIGM5) (frozen in liquid nitrogen) were used. The cells were each inoculated with 2 ml Iscove's medium (Biochrom AG) supplemented with 20% fetal calf serum (FCS). Subsequently, the cell cultures were incubated in 12 well plates for 24 hours at 37° C. in 5% $CO_2$. Subsequently, the content of the 18 wells was parted in 2 parts with the same volume so that finally 3 plates of the same format (36 wells in total) were available. Afterwards, the cultivation was continued under the same conditions for 24 hours. Afterwards, the resulting cultures of 11 wells of each plate were combined and centrifuged (1000×g, 5 min, ambient temperature). The supernatant was removed and the cell pellet was dissolved in 40 ml of the above mentioned medium. These 40 ml of dissolved cells were distributed in equal shares in two 250 ml flasks and incubated after adding 5 ml of the above-mentioned medium. 80 µl of the remaining 2 ml of the two remaining plates were placed in empty wells of the same plates that had previously been prepared with 1 ml of the above-mentioned medium. After 48 hours of incubation, only one of the 12 well plates was processed as follows: 500 µl were extracted from each well and combined. The resulting 6 ml were introduced into a 250 ml flask comprising approximately 10 ml of fresh medium. This mixture was centrifuged 5 minutes with 1000×g at ambient temperature and dissolved in 10 ml of the above-mentioned medium. The following results were obtained by subsequent counting of cells: 1.5×107 cells per ml, 10 ml total volume, total number of cells: 1.5×108. As the number of cells was not yet sufficient, 2.5 ml of the above-mentioned cell suspension was introduced into 30 ml of the above-mentioned medium in a 250 ml (75 $cm^2$) flask (4 flasks in total). After 72 hours of incubation 20 ml of fresh medium were added to each flask. After the subsequent incubation of 24 hours, the cells were counted as described above. The total amount of cells was $3.8 \times 10^8$ cells. In order to obtain the desired number of cells of 2×106 cells, the cells were resuspended in 47.5 ml of the above mentioned medium in 4 flasks. After the incubation time of 24 hours, the cells were centrifuged and washed two times with phosphate buffer in absence of $Ca^{2+}$ and $Mg^{2+}$ (Biochrom AG).

The isolation of the total RNA is performed by means of NucleoSpin RNA L Kits (Machery&Nagel) according to the manufacturer's instructions. The above described process was repeated until the necessary number of cells was obtained. This was necessary to obtain the necessary amount of 6 mg total RNA corresponding to an efficiency of 600 µg RNA per 108 cells.

Reverse Transcription/Labelling/Hybridisation

After drawing whole blood, the total RNA of the samples was isolated and tested for quality using the PAXGene Blood RNA kit (PreAnalytiX) according to the manufacturer's instructions. 10 µg total RNA were aliquoted from each sample and transcribed with 10 µg total RNA from SIGM5 cells as reference RNA to complementary DNA (cDNA) by means of the reverse transcriptase Superscript II (Invitrogen). Subsequently, the RNA is removed from the mixture by alkaline hydrolysis. In the reaction mixture a part of the dTTP was replaced by aminoallyl-dUTP (AA-dUTP) in order to render the linkage of the fluorescent dye to the cDNA possible at a later point of time.

After the purification of the reaction mixture, the cDNA of the samples and the controls were covalently labelled with the fluorescent dyes Alexa 647 and Alexa 555 and hybridised on a microarray of the SIRS-Lab company. On the microarray used, 5308 different polynucleotides with lengths of 55 to 70 base pairs were immobilised. Each of the polynucleotides represents a human gene. Additionally, there were control spots for quality assurance. One microarray is divided into 28 subarrays, each of the subarrays being arranged in a grid of 15×15 spots.

The hybridisation and the subsequent washing and drying, respectively, were carried out using the hybridisation station HS 400 (Tecon) according to the manufacturer's instructions for 10.5 hours at 42° C. The hybridisation solution used was composed of the cDNA samples, each labelled, 3.5×SSC (1×SSC comprises 150 mM NaCl and 15 mM sodiumcitrate), 0.3% sodium lauryl sulfate (v/v) 25% formamide (v/v) and each 0.8 µg µl-1 cot-1 DNA, yeast t-RNA and poly-A RNA. The subsequent washing of the microarrays was carried out at ambient temperature according to the following scheme: Rinse 90 seconds with washing buffer 1 (2×SSC, 0.03% sodium lauryl sulfate), with washing buffer 2 (1×SSC) and finally with washing buffer 3 (0.2×SSC). Subsequently, the microarrays were dried under a nitrogen flow at a pressure of 2.5 bar for more than 150 seconds at 30° C.

The hybridisation signals of the processed microarrays were subsequently read by means of the GenePix 4000B (Axon) scanner and the expression ratios of the different expressed genes were determined by means of the GenePix Pro 4.0 (Axon) software.

Evaluation:

For the analysis, the average intensity of one spot was determined as median value of the corresponding spot pixel.

Correction of Systemic Errors:

Systematic errors were corrected according to the approach of Huber et al. (2002). According to this approach, the additive and the multiplicative bias in a microarray was estimated on the basis of 70% of the gene samples present. For all further computations, the signal was transformed by means of arcus sinus hyperbolicus.

For the analysis, the normalised and transformed relative ratios of the signals of the patients samples were calculated with respect to the control. This means that the calculation for the gene no. j of the patient no. n revealed the data $G_{j,n} = \text{arcsinh}(S_{Cy5 j,n}) - \text{arcsinh}(S_{Cy3 j,n})$, wherein $[S_{Cy3 j,n}, S_{Cy5 j,n}]$ is the associated signal pair. When a spot could not be analysed for a patient (e.g. scanned picture is stained), the associated value was marked as "missing value".

Statistical Comparison:

For comparison the paired random student test was employed per gene. Both random samples contained the values of the patient groups of non-infectious MOF and infectious MOF, respectively. For choosing the differentially expressed genes, the associated p-value and the number of missing values were evaluated. It applied for the group of the selected genes that the associated p-value was smaller than 0.05.

The criterion for the grading of the examined genes was the level of the expression ratio of each gene. The most overexpressed or underexpressed genes, respectively, in the patients suffering from non-infectious MOF compared to patients suffering from infectious MOF were the interesting ones.

Table 2 shows that 721 genes of the patient sample were found, which were significantly overexpressed in the patients with infectious MOF, if compared with patients with non-infectious MOF. Furthermore, Table 3 shows that 576 genes of the patients with infectious MOF were significantly underexpressed, if compared with patients with non-infectious MOF. From the results it is clear that the gene activities listed in Table 2 and Table 3 distinguish between non-infectious causes of multiple organ failure and infectious causes of multiple organ failure. Thus, the listed gene activities provide markers for the differentiation between non-infectious and infectious causes of multiple organ failure.

TABLE 2

Significantly elevated gene activities in samples of patients with infectious MOF, if compared with the gene activities of patients with non-infectious MOF.

| | | Mean normalised and transformed expression value | | Standard deviation | | |
|---|---|---|---|---|---|---|
| GenBank Accession No. | p-value | Group of patients with non-infectious MOF | Group of patients with infectious MOF | Group of patients with non-infectious MOF | Group of patients with infectious MOF | SEQUENCE-ID |
| N32857 | 0.00 | −2.99 | 0.20 | 1.42 | 2.78 | 1 |
| N32853 | 0.00 | −0.85 | 1.60 | 2.15 | 2.89 | 2 |
| N32495 | 0.00 | −2.38 | −0.56 | 1.37 | 0.40 | 3 |
| AI701077 | 0.01 | −0.33 | 1.46 | 0.17 | 3.08 | 4 |
| M87790 | 0.00 | 1.18 | 2.93 | 1.13 | 1.24 | 5 |
| AI559317 | 0.01 | 0.20 | 1.83 | 0.54 | 2.60 | 6 |
| N34897 | 0.00 | −2.60 | −1.05 | 1.61 | 0.54 | 7 |
| AA907084 | 0.02 | 0.53 | 1.94 | 0.49 | 2.58 | 8 |
| N45223 | 0.00 | −2.88 | −1.54 | 1.24 | 0.57 | 9 |
| H70430 | 0.03 | 0.12 | 1.42 | 0.70 | 2.73 | 10 |
| R59591 | 0.01 | −0.25 | 0.97 | 0.20 | 2.06 | 11 |
| N47688 | 0.00 | −2.47 | −1.27 | 0.94 | 0.44 | 12 |
| N52930 | 0.00 | −1.49 | −0.30 | 1.06 | 0.76 | 13 |
| XM_004256 | 0.00 | −3.10 | −1.94 | 0.62 | 1.43 | 14 |
| AJ010446 | 0.00 | −0.22 | 0.93 | 0.66 | 1.11 | 15 |
| N35225 | 0.00 | −2.81 | −1.75 | 1.21 | 0.52 | 16 |
| N50680 | 0.00 | −1.30 | −0.29 | 1.58 | 0.46 | 17 |
| BC018761 | 0.00 | 1.04 | 2.02 | 0.80 | 1.27 | 18 |
| XM_009475 | 0.00 | −2.54 | −1.58 | 0.83 | 0.91 | 19 |
| N53369 | 0.04 | −0.37 | 0.55 | 1.62 | 1.39 | 20 |
| AI420863 | 0.05 | −0.17 | 0.74 | 0.47 | 1.99 | 21 |
| N33423 | 0.05 | −0.32 | 0.58 | 1.64 | 1.51 | 22 |
| AA843281 | 0.05 | 0.27 | 1.15 | 0.54 | 1.88 | 23 |
| X64641 | 0.02 | 0.26 | 1.11 | 1.09 | 1.23 | 24 |
| N52545 | 0.00 | −1.10 | −0.28 | 1.02 | 0.55 | 25 |
| X57817 | 0.01 | 0.19 | 1.00 | 0.58 | 1.21 | 26 |
| N58236 | 0.00 | −0.68 | 0.14 | 0.85 | 0.56 | 27 |
| XM_056556 | 0.00 | −3.12 | −2.31 | 0.58 | 0.99 | 28 |
| N59170 | 0.01 | −0.22 | 0.59 | 1.35 | 0.74 | 29 |
| N58392 | 0.00 | −0.85 | −0.04 | 0.71 | 0.62 | 30 |
| N34672 | 0.02 | −0.54 | 0.26 | 1.74 | 0.39 | 31 |
| XM_015396 | 0.00 | −0.27 | 0.52 | 0.68 | 0.81 | 32 |
| X05875 | 0.01 | −2.86 | −2.09 | 0.55 | 1.15 | 33 |
| N48715 | 0.00 | −1.12 | −0.36 | 0.70 | 0.61 | 34 |
| N90140 | 0.05 | −0.44 | 0.32 | 0.29 | 1.71 | 35 |
| NM_002415 | 0.00 | −1.66 | −0.90 | 0.63 | 0.56 | 36 |
| AI890242 | 0.00 | −0.14 | 0.59 | 0.25 | 0.72 | 37 |
| AI589096 | 0.00 | −0.39 | 0.32 | 0.56 | 0.54 | 38 |
| NM_001911 | 0.04 | −2.61 | −1.91 | 0.77 | 1.44 | 39 |
| N39242 | 0.05 | −0.56 | 0.12 | 1.75 | 0.52 | 40 |
| N35493 | 0.04 | −0.45 | 0.23 | 1.69 | 0.46 | 41 |
| AI271764 | 0.00 | −0.66 | −0.02 | 0.70 | 0.62 | 42 |
| NM_006936 | 0.00 | −2.00 | −1.37 | 0.46 | 0.55 | 43 |
| NM_005225 | 0.00 | −0.90 | −0.26 | 0.58 | 0.53 | 44 |
| R98960 | 0.04 | −0.37 | 0.26 | 1.41 | 0.70 | 45 |
| NM_000714.3 | 0.00 | 0.48 | 1.11 | 0.44 | 0.88 | 46 |
| N48180 | 0.01 | −1.08 | −0.45 | 1.05 | 0.45 | 47 |
| NM_002295 | 0.02 | −3.17 | −2.56 | 0.44 | 1.09 | 48 |
| AI697365 | 0.01 | 0.62 | 1.22 | 0.82 | 0.67 | 49 |
| NM_001404 | 0.00 | −2.56 | −1.96 | 0.38 | 0.86 | 50 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| NM_176800.1 | 0.00 | −0.31 | 0.29 | 0.51 | 0.42 | 51 |
| XM_027885 | 0.03 | −3.23 | −2.63 | 0.37 | 1.17 | 52 |
| NM_006597.3 | 0.00 | −2.42 | −1.84 | 0.50 | 0.79 | 53 |
| NM_002211 | 0.00 | −1.59 | −1.02 | 0.68 | 0.54 | 54 |
| NM_001570 | 0.00 | −0.55 | 0.03 | 0.53 | 0.49 | 55 |
| AI888606 | 0.03 | −0.16 | 0.40 | 0.44 | 1.11 | 56 |
| NM_006636.2 | 0.04 | −3.49 | −2.93 | 0.53 | 1.16 | 57 |
| AA458827 | 0.00 | 0.15 | 0.71 | 0.33 | 0.60 | 58 |
| AA398757 | 0.01 | 0.11 | 0.67 | 0.57 | 0.81 | 59 |
| NM_000814.2 | 0.00 | −0.07 | 0.49 | 0.48 | 0.75 | 60 |
| NM_000963 | 0.00 | −0.41 | 0.15 | 0.86 | 0.33 | 61 |
| AI913322 | 0.02 | −0.68 | −0.14 | 0.68 | 0.92 | 62 |
| N20922 | 0.04 | −0.72 | −0.17 | 1.27 | 0.51 | 63 |
| R49085 | 0.00 | 0.02 | 0.57 | 0.64 | 0.56 | 64 |
| N54935 | 0.01 | −0.74 | −0.19 | 0.97 | 0.38 | 65 |
| XM_027358 | 0.01 | −1.49 | −0.95 | 0.75 | 0.59 | 66 |
| NM_031200 | 0.00 | 0.11 | 0.65 | 0.57 | 0.57 | 67 |
| AA805531 | 0.00 | −0.07 | 0.47 | 0.33 | 0.53 | 68 |
| NM_000194 | 0.04 | −2.64 | −2.12 | 0.70 | 1.02 | 69 |
| AI623567 | 0.01 | 0.39 | 0.92 | 0.59 | 0.73 | 70 |
| N64495 | 0.00 | −0.49 | 0.02 | 0.63 | 0.37 | 71 |
| NM_002156 | 0.01 | −2.26 | −1.75 | 0.59 | 0.70 | 72 |
| NM_012068 | 0.00 | −1.40 | −0.89 | 0.54 | 0.40 | 73 |
| R43722 | 0.02 | −0.45 | 0.05 | 0.65 | 0.80 | 74 |
| NM_001686 | 0.03 | −2.63 | −2.13 | 0.32 | 0.93 | 75 |
| NM_002969 | 0.00 | −0.92 | −0.42 | 0.46 | 0.53 | 76 |
| NM_003295 | 0.04 | −2.72 | −2.24 | 0.45 | 0.98 | 77 |
| XM_039372 | 0.02 | −2.43 | −1.95 | 0.26 | 0.92 | 78 |
| AA731679 | 0.02 | 0.17 | 0.65 | 0.79 | 0.61 | 79 |
| AA620762 | 0.00 | −0.04 | 0.44 | 0.21 | 0.50 | 80 |
| AI499889 | 0.01 | −0.01 | 0.47 | 0.67 | −0.64 | 81 |
| N33530 | 0.00 | −0.30 | 0.18 | 0.70 | 0.31 | 82 |
| NM_002033 | 0.00 | −1.92 | −1.44 | 0.39 | 0.63 | 83 |
| AA436651 | 0.00 | −0.26 | 0.21 | 0.54 | 0.26 | 84 |
| NM_001540 | 0.00 | −1.42 | −0.95 | 0.42 | 0.54 | 85 |
| NM_004257 | 0.00 | −0.85 | −0.38 | 0.33 | 0.25 | 86 |
| NM_014280.1 | 0.00 | −1.45 | −0.98 | 0.58 | 0.47 | 87 |
| NM_000930.2 | 0.00 | −1.30 | −0.83 | 0.64 | 0.51 | 88 |
| XM_002101 | 0.00 | −0.63 | −0.17 | 0.63 | 0.27 | 89 |
| AI733269 | 0.00 | −0.18 | 0.29 | 0.45 | 0.36 | 90 |
| NM_001168 | 0.02 | −2.14 | −1.67 | 0.61 | 0.77 | 91 |
| XM_052636 | 0.00 | −1.51 | −1.04 | 0.35 | 0.48 | 92 |
| AI689318 | 0.00 | −1.00 | −0.54 | 0.55 | 0.46 | 93 |
| NM_001212 | 0.01 | −1.65 | −1.19 | 0.56 | 0.64 | 94 |
| R37251 | 0.00 | 0.61 | 1.06 | 0.39 | 0.63 | 95 |
| NM_001166 | 0.00 | −0.76 | −0.31 | 0.53 | 0.41 | 96 |
| XM_056798 | 0.01 | −1.34 | −0.89 | 0.66 | 0.51 | 97 |
| NM_005052 | 0.01 | 0.41 | 0.86 | 0.37 | 0.67 | 98 |
| NM_003379 | 0.00 | −1.45 | −1.00 | 0.41 | 0.51 | 99 |
| XM_048068 | 0.00 | −0.37 | 0.08 | 0.43 | 0.42 | 100 |
| NM_000577 | 0.01 | 0.45 | 0.90 | 0.32 | 0.67 | 101 |
| NM_001101 | 0.00 | −0.69 | −0.25 | 0.43 | 0.58 | 102 |
| D31890 | 0.01 | −1.79 | −1.36 | 0.56 | 0.55 | 103 |
| N49976 | 0.03 | −0.26 | 0.17 | 0.90 | 0.50 | 104 |
| XM_008679 | 0.01 | −0.85 | −0.41 | 0.57 | 0.56 | 105 |
| N33187 | 0.01 | −0.06 | 0.38 | 0.52 | 0.54 | 106 |
| R42782 | 0.00 | −0.09 | 0.34 | 0.36 | 0.45 | 107 |
| N49751 | 0.01 | 0.71 | 1.14 | 0.48 | 0.64 | 108 |
| AI910456 | 0.04 | −1.12 | −0.69 | 0.73 | 0.75 | 109 |
| NM_001569 | 0.00 | −1.10 | −0.67 | 0.38 | 0.46 | 110 |
| H90322 | 0.00 | 0.05 | 0.48 | 0.27 | 0.51 | 111 |
| AI926659 | 0.00 | 0.05 | 0.48 | 0.37 | 0.44 | 112 |
| XM_047499 | 0.01 | −1.29 | −0.86 | 0.46 | 0.67 | 113 |
| AA437224 | 0.00 | −0.71 | −0.28 | 0.46 | 0.24 | 114 |
| NM_021798 | 0.00 | −0.32 | 0.11 | 0.44 | 0.36 | 115 |
| NM_000584 | 0.02 | −1.82 | −1.40 | 0.61 | 0.64 | 116 |
| AA452122 | 0.00 | −0.40 | 0.02 | 0.60 | 0.41 | 117 |
| NM_002189 | 0.01 | 0.10 | 0.52 | 0.48 | 0.57 | 118 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| AA001367 | 0.00 | −0.13 | 0.29 | 0.37 | 0.57 | 119 |
| AI129679 | 0.00 | −1.27 | −0.85 | 0.31 | 0.37 | 120 |
| D26599 | 0.01 | −1.90 | −1.48 | 0.50 | 0.58 | 121 |
| NM_170665.2 | 0.00 | −1.19 | −0.78 | 0.49 | 0.45 | 122 |
| NM_006419 | 0.00 | −0.16 | 0.25 | 0.39 | 0.51 | 123 |
| W85706 | 0.00 | −1.07 | −0.66 | 0.30 | 0.37 | 124 |
| AA897528 | 0.00 | −0.50 | −0.09 | 0.65 | 0.30 | 125 |
| NM_003358 | 0.04 | 0.56 | 0.97 | 0.50 | 0.82 | 126 |
| N35251 | 0.00 | −0.18 | 0.22 | 0.52 | 0.41 | 127 |
| NM_004863 | 0.00 | −0.63 | −0.22 | 0.37 | 0.48 | 128 |
| NM_001950 | 0.00 | −0.82 | −0.41 | 0.40 | 0.33 | 129 |
| NM_006260 | 0.03 | −0.63 | −0.22 | 0.61 | 0.67 | 130 |
| NM_170708 | 0.03 | −1.52 | −1.12 | 0.54 | 0.63 | 131 |
| N63024 | 0.01 | 0.64 | 1.04 | 0.43 | 0.56 | 132 |
| NM_017595 | 0.00 | −0.85 | −0.45 | 0.36 | 0.33 | 133 |
| AI364529 | 0.02 | −0.97 | −0.57 | 0.59 | 0.59 | 134 |
| NM_013432 | 0.00 | −0.30 | 0.10 | 0.31 | 0.28 | 135 |
| NM_006736.2 | 0.00 | −0.56 | −0.16 | 0.24 | 0.37 | 136 |
| NM_002128 | 0.02 | −1.84 | −1.44 | 0.40 | 0.69 | 137 |
| AA441793 | 0.00 | −0.70 | −0.31 | 0.45 | 0.33 | 138 |
| N76019 | 0.00 | −0.27 | 0.13 | 0.35 | 0.30 | 139 |
| XM_048665 | 0.00 | −0.28 | 0.11 | 0.38 | 0.35 | 140 |
| NM_003467 | 0.01 | −1.80 | −1.41 | 0.32 | 0.62 | 141 |
| N59330 | 0.01 | −0.21 | 0.19 | 0.56 | 0.50 | 142 |
| NM_004672 | 0.00 | −0.08 | 0.32 | 0.44 | 0.26 | 143 |
| AA426021 | 0.01 | 0.06 | 0.45 | 0.28 | 0.61 | 144 |
| XM_008608 | 0.00 | −0.60 | −0.21 | 0.54 | 0.34 | 145 |
| H44908 | 0.00 | −0.55 | −0.16 | 0.42 | 0.33 | 146 |
| AA699412 | 0.00 | −0.47 | −0.08 | 0.48 | 0.35 | 147 |
| AI572080 | 0.01 | 0.28 | 0.67 | 0.41 | 0.52 | 148 |
| NM_012072 | 0.02 | −1.86 | −1.47 | 0.47 | 0.63 | 149 |
| XM_035638 | 0.04 | −1.96 | −1.57 | 0.40 | 0.80 | 150 |
| BC001604 | 0.00 | −1.13 | −0.74 | 0.40 | 0.33 | 151 |
| AA481282 | 0.00 | −0.11 | 0.27 | 0.54 | 0.40 | 152 |
| NM_003376 | 0.01 | −1.17 | −0.78 | 0.54 | 0.42 | 153 |
| H11661 | 0.00 | −0.07 | 0.32 | 0.25 | 0.37 | 154 |
| AI435179 | 0.01 | −0.08 | 0.30 | 0.68 | 0.37 | 155 |
| XM_006800 | 0.01 | 0.19 | 0.57 | 0.38 | 0.55 | 156 |
| NM_000397.2 | 0.00 | −0.56 | −0.17 | 0.37 | 0.28 | 157 |
| AA424023 | 0.02 | 0.01 | 0.39 | 0.43 | 0.63 | 158 |
| XM_012949 | 0.02 | −1.81 | −1.43 | 0.45 | 0.64 | 159 |
| W84866 | 0.00 | 0.14 | 0.52 | 0.44 | 0.45 | 160 |
| N62672 | 0.01 | −0.21 | 0.17 | 0.60 | 0.44 | 161 |
| NM_001530 | 0.01 | −0.16 | 0.21 | 0.25 | 0.62 | 162 |
| NM_002157.1 | 0.03 | −2.21 | −1.83 | 0.43 | 0.71 | 163 |
| NM_003258 | 0.02 | −1.80 | −1.43 | 0.68 | 0.46 | 164 |
| AI863135 | 0.04 | 0.87 | 1.25 | 0.40 | 0.76 | 165 |
| NM_004083 | 0.01 | −0.95 | −0.58 | 0.46 | 0.47 | 166 |
| H06194 | 0.00 | −0.92 | −0.54 | 0.45 | 0.30 | 167 |
| XM_047570 | 0.03 | −1.61 | −1.24 | 0.41 | 0.68 | 168 |
| D26598 | 0.01 | −1.23 | −0.86 | 0.27 | 0.57 | 169 |
| R44955 | 0.01 | −0.08 | 0.29 | 0.55 | 0.49 | 170 |
| NM_012297 | 0.02 | −1.60 | −1.22 | 0.48 | 0.59 | 171 |
| T84080 | 0.02 | 0.13 | 0.49 | 0.57 | 0.52 | 172 |
| H52810 | 0.00 | 0.13 | 0.50 | 0.33 | 0.44 | 173 |
| XM_055188 | 0.04 | 0.94 | 1.30 | 0.36 | 0.75 | 174 |
| AI184987 | 0.01 | 0.19 | 0.56 | 0.51 | 0.50 | 175 |
| AI733177 | 0.02 | 0.54 | 0.90 | 0.41 | 0.63 | 176 |
| NM_006016 | 0.02 | −1.15 | −0.78 | 0.44 | 0.60 | 177 |
| XM_006867 | 0.02 | 0.09 | 0.46 | 0.33 | 0.62 | 178 |
| NM_004475.1 | 0.02 | 0.95 | 1.32 | 0.40 | 0.60 | 179 |
| AA485242 | 0.03 | 0.34 | 0.70 | 0.49 | 0.62 | 180 |
| NM_003300 | 0.01 | −1.49 | −1.13 | 0.31 | 0.54 | 181 |
| NM_032957 | 0.00 | −0.88 | −0.52 | 0.32 | 0.39 | 182 |
| XM_033862 | 0.00 | −0.01 | 0.35 | 0.29 | 0.36 | 183 |
| W80385 | 0.01 | 0.10 | 0.46 | 0.36 | 0.52 | 184 |
| H99099 | 0.01 | −0.04 | 0.32 | 0.37 | 0.52 | 185 |
| N67859 | 0.00 | −0.77 | −0.41 | 0.34 | 0.39 | 186 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| NM_001013 | 0.04 | −1.88 | −1.52 | 0.44 | 0.68 | 187 |
| NM_006641 | 0.02 | −0.36 | 0.00 | 0.69 | 0.35 | 188 |
| N70546 | 0.00 | −0.11 | 0.25 | 0.38 | 0.40 | 189 |
| XM_015278 | 0.00 | −0.36 | −0.01 | 0.33 | 0.42 | 190 |
| AI932670 | 0.00 | −0.15 | 0.20 | 0.36 | 0.43 | 191 |
| NM_175617 | 0.00 | −0.11 | 0.25 | 0.29 | 0.26 | 192 |
| NM_004377.2 | 0.02 | −0.88 | −0.53 | 0.52 | 0.50 | 193 |
| NM_003153 | 0.00 | −0.39 | −0.04 | 0.30 | 0.48 | 194 |
| AI910804 | 0.03 | −0.65 | −0.30 | 0.51 | 0.57 | 195 |
| AI221860 | 0.00 | −0.30 | 0.05 | 0.17 | 0.43 | 196 |
| AI866414 | 0.00 | −0.37 | −0.02 | 0.33 | 0.27 | 197 |
| BC020968 | 0.03 | −1.77 | −1.42 | 0.36 | 0.65 | 198 |
| AA484213 | 0.05 | −0.49 | −0.14 | 0.90 | 0.27 | 199 |
| XM_003593 | 0.00 | −0.52 | −0.17 | 0.44 | 0.27 | 200 |
| XM_008738 | 0.02 | −1.46 | −1.11 | 0.54 | 0.49 | 201 |
| NM_032964 | 0.00 | −0.48 | −0.13 | 0.41 | 0.20 | 202 |
| NM_001455 | 0.00 | 0.26 | 0.61 | 0.42 | 0.41 | 203 |
| NM_002994 | 0.00 | −0.61 | −0.26 | 0.35 | 0.43 | 204 |
| NM_004222 | 0.00 | −1.44 | −1.10 | 0.30 | 0.45 | 205 |
| H48923 | 0.00 | −0.59 | −0.25 | 0.35 | 0.39 | 206 |
| T47430 | 0.05 | 0.41 | 0.75 | 0.38 | 0.71 | 207 |
| NM_032963 | 0.00 | −0.45 | −0.11 | 0.52 | 0.22 | 208 |
| XM_045933 | 0.00 | 0.22 | 0.56 | 0.23 | −0.41 | 209 |
| T99746 | 0.03 | 0.26 | 0.60 | 0.49 | 0.52 | 210 |
| XM_012039 | 0.01 | −1.44 | −1.10 | 0.44 | 0.43 | 211 |
| NM_004740 | 0.00 | −0.46 | −0.12 | 0.29 | 0.24 | 212 |
| NM_001681.2 | 0.05 | −1.39 | −0.05 | 0.61 | 0.60 | 213 |
| AI027259 | 0.00 | −0.40 | −0.06 | 0.49 | 0.28 | 214 |
| AA431552 | 0.00 | −0.63 | −0.30 | 0.41 | 0.32 | 215 |
| NM_000029 | 0.00 | 0.30 | 0.63 | 0.32 | 0.42 | 216 |
| XM_041847 | 0.05 | −1.02 | −0.68 | 0.69 | 0.51 | 217 |
| NM_005920 | 0.00 | −0.90 | −0.56 | 0.28 | 0.33 | 218 |
| NM_002394 | 0.01 | −1.03 | −0.69 | 0.49 | 0.39 | 219 |
| AI093704 | 0.01 | −0.32 | 0.02 | 0.35 | 0.47 | 220 |
| XM_043359 | 0.01 | 0.21 | 0.55 | 0.36 | 0.51 | 221 |
| H48445 | 0.01 | 0.28 | 0.61 | 0.38 | 0.53 | 222 |
| XM_015815 | 0.02 | −1.13 | −0.80 | 0.52 | 0.50 | 223 |
| NM_001774 | 0.00 | −0.07 | 0.27 | 0.31 | 0.42 | 224 |
| AI937053 | 0.00 | −0.42 | −0.09 | 0.39 | 0.26 | 225 |
| AA493719 | 0.01 | −0.61 | −0.28 | 0.52 | 0.35 | 226 |
| NM_002996 | 0.01 | 0.19 | 0.51 | 0.33 | 0.44 | 227 |
| AI025039 | 0.01 | 0.16 | 0.49 | 0.31 | 0.47 | 228 |
| NM_139049 | 0.02 | −0.52 | −0.19 | 0.60 | 0.34 | 229 |
| NM_006238.2 | 0.00 | −0.29 | 0.04 | 0.21 | 0.26 | 230 |
| XM_031456 | 0.00 | −0.67 | −0.35 | 0.30 | 0.30 | 231 |
| AA455096 | 0.00 | −0.29 | 0.03 | 0.29 | 0.32 | 232 |
| XM_047675 | 0.03 | 0.36 | 0.68 | 0.26 | 0.65 | 233 |
| AI809252 | 0.00 | −0.14 | 0.18 | 0.36 | 0.34 | 234 |
| NM_139047 | 0.00 | −0.45 | −0.13 | 0.47 | 0.31 | 235 |
| AI760793 | 0.01 | −0.47 | −0.15 | 0.47 | 0.33 | 236 |
| NM_000204 | 0.00 | −0.03 | 0.29 | 0.25 | 0.40 | 237 |
| AI860121 | 0.01 | 0.55 | 0.87 | 0.37 | 0.48 | 238 |
| H50222 | 0.00 | −0.13 | 0.19 | 0.19 | 0.34 | 239 |
| XM_041101 | 0.02 | −1.06 | −0.74 | 0.34 | 0.56 | 240 |
| XM_035854 | 0.01 | 0.09 | 0.41 | 0.47 | 0.44 | 241 |
| AA043903 | 0.01 | −0.73 | −0.41 | 0.52 | 0.31 | 242 |
| R40406 | 0.03 | −0.89 | −0.58 | 0.48 | 0.52 | 243 |
| N98510 | 0.04 | −1.22 | −0.90 | 0.51 | 0.56 | 244 |
| H05449 | 0.03 | −0.15 | 0.16 | 0.52 | 0.50 | 245 |
| AI567338 | 0.01 | −0.11 | 0.20 | 0.43 | 0.39 | 246 |
| NM_000308.1 | 0.00 | −0.19 | 0.13 | 0.29 | 0.42 | 247 |
| R40880 | 0.00 | −0.21 | 0.11 | 0.40 | 0.34 | 248 |
| H52284 | 0.00 | −0.26 | 0.05 | 0.41 | 0.27 | 249 |
| NM_030662 | 0.00 | −0.47 | −0.16 | 0.22 | 0.27 | 250 |
| NM_032965 | 0.02 | 0.52 | 0.83 | 0.41 | 0.47 | 251 |
| NM_004322 | 0.00 | −0.34 | −0.03 | 0.32 | 0.27 | 252 |
| XM_002762 | 0.00 | −0.52 | −0.21 | 0.22 | 0.25 | 253 |
| AI679230 | 0.00 | −0.40 | −0.09 | 0.43 | 0.33 | 254 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| AI368670 | 0.00 | −0.23 | 0.08 | 0.30 | 0.31 | 255 |
| NM_006415 | 0.01 | −0.71 | −0.40 | 0.45 | 0.33 | 256 |
| NM_004379 | 0.00 | −0.54 | −0.23 | 0.24 | 0.24 | 257 |
| NM_002974 | 0.02 | 0.02 | 0.33 | 0.49 | 0.38 | 258 |
| AI914729 | 0.02 | −0.11 | 0.20 | 0.51 | 0.40 | 259 |
| NM_032989 | 0.00 | −0.17 | 0.14 | 0.23 | 0.28 | 260 |
| AI799645 | 0.04 | 0.14 | 0.45 | 0.39 | 0.61 | 261 |
| AA436553 | 0.01 | −0.33 | −0.03 | 0.59 | 0.24 | 262 |
| NM_033015 | 0.00 | −0.37 | −0.06 | 0.32 | 0.25 | 263 |
| XM_002224 | 0.01 | −0.26 | 0.04 | 0.57 | 0.28 | 264 |
| AI708030 | 0.00 | 0.11 | 0.41 | 0.37 | 0.32 | 265 |
| AI041544 | 0.00 | −0.28 | 0.02 | 0.28 | 0.27 | 266 |
| NM_005801 | 0.03 | −1.39 | −1.09 | 0.36 | 0.54 | 267 |
| NM_022559 | 0.00 | −0.63 | −0.33 | 0.42 | 0.24 | 268 |
| XM_043864 | 0.00 | −0.40 | −0.10 | 0.32 | 0.31 | 269 |
| NM_003840 | 0.01 | −0.42 | −0.12 | 0.52 | 0.25 | 270 |
| AI565083 | 0.00 | −0.28 | 0.02 | 0.32 | 0.24 | 271 |
| R91168 | 0.01 | 0.15 | 0.45 | 0.36 | 0.40 | 272 |
| AI799787 | 0.01 | 0.12 | 0.41 | 0.34 | 0.38 | 273 |
| AI652564 | 0.00 | −0.91 | −0.61 | 0.31 | 0.30 | 274 |
| H05310 | 0.00 | 0.02 | 0.32 | 0.30 | 0.29 | 275 |
| AA708806 | 0.00 | −0.22 | 0.08 | 0.24 | 0.26 | 276 |
| H74205 | 0.03 | 0.07 | 0.37 | 0.42 | 0.49 | 277 |
| NM_000061 | 0.03 | −1.59 | −1.30 | 0.40 | 0.53 | 278 |
| NM_003110.3 | 0.00 | −0.29 | 0.00 | 0.38 | 0.27 | 279 |
| AA625887 | 0.00 | −0.30 | −0.01 | 0.22 | 0.23 | 280 |
| H41124 | 0.03 | −0.37 | −0.08 | 0.39 | 0.48 | 281 |
| AI769514 | 0.02 | −0.58 | −0.28 | 0.56 | 0.35 | 282 |
| XM_036107 | 0.03 | −0.27 | 0.02 | 0.27 | 0.53 | 283 |
| R52679 | 0.01 | −1.03 | −0.74 | 0.36 | 0.35 | 284 |
| AI217811 | 0.04 | 0.02 | 0.31 | 0.31 | 0.59 | 285 |
| NM_004168 | 0.02 | −0.63 | −0.34 | 0.42 | 0.44 | 286 |
| AI933607 | 0.03 | −0.24 | 0.05 | 0.32 | 0.55 | 287 |
| NM_007052.3 | 0.03 | −0.24 | 0.05 | 0.61 | 0.29 | 288 |
| AI799137 | 0.02 | −0.42 | −0.12 | 0.52 | 0.37 | 289 |
| NM_002720 | 0.00 | −0.64 | −0.35 | 0.28 | 0.34 | 290 |
| R26635 | 0.04 | −0.16 | 0.13 | 0.32 | 0.57 | 291 |
| AI625594 | 0.00 | −0.01 | 0.28 | 0.29 | 0.31 | 292 |
| NM_001562 | 0.00 | −0.42 | −0.13 | 0.22 | 0.27 | 293 |
| W93717 | 0.05 | 0.11 | 0.40 | 0.64 | 0.40 | 294 |
| NM_002521.1 | 0.01 | −0.10 | 0.19 | 0.44 | 0.29 | 295 |
| R42543 | 0.05 | 0.26 | 0.55 | 0.45 | 0.54 | 296 |
| AI302949 | 0.00 | −0.13 | 0.16 | 0.21 | 0.23 | 297 |
| H54279 | 0.00 | −0.01 | 0.27 | 0.29 | 0.32 | 298 |
| AI219513 | 0.00 | −0.47 | −0.19 | 0.41 | 0.27 | 299 |
| N68173 | 0.00 | −0.11 | 0.18 | 0.26 | 0.38 | 300 |
| AA496235 | 0.00 | −0.38 | −0.09 | 0.41 | 0.28 | 301 |
| AI742529 | 0.03 | 0.39 | 0.67 | 0.33 | 0.51 | 302 |
| H79534 | 0.01 | −0.50 | −0.21 | 0.47 | 0.32 | 303 |
| AA002267 | 0.03 | −0.04 | 0.25 | 0.36 | 0.47 | 304 |
| H52638 | 0.00 | −0.38 | −0.10 | 0.40 | 0.28 | 305 |
| N70324 | 0.01 | 0.07 | 0.35 | 0.47 | 0.33 | 306 |
| NM_003805 | 0.02 | −0.83 | −0.55 | 0.47 | 0.36 | 307 |
| N59766 | 0.03 | −0.04 | 0.24 | 0.41 | 0.43 | 308 |
| XM_034770 | 0.04 | −1.26 | −0.98 | 0.44 | 0.45 | 309 |
| AI538438 | 0.01 | 0.06 | 0.34 | 0.43 | 0.31 | 310 |
| AI250800 | 0.00 | 0.05 | 0.32 | 0.23 | 0.29 | 311 |
| AA845475 | 0.00 | −0.24 | 0.04 | 0.39 | 0.25 | 312 |
| AI700169 | 0.00 | −0.23 | 0.05 | 0.33 | 0.30 | 313 |
| NM_003639) | 0.00 | −0.37 | −0.09 | 0.26 | 0.31 | 314 |
| AI125864 | 0.03 | −0.27 | 0.01 | 0.60 | 0.24 | 315 |
| NM_000757 | 0.03 | 0.12 | 0.40 | 0.38 | 0.48 | 316 |
| NM_006216 | 0.03 | −0.12 | 0.16 | 0.45 | 0.42 | 317 |
| AI077481 | 0.04 | 0.21 | 0.49 | 0.41 | 0.48 | 318 |
| AI149647 | 0.03 | −0.13 | 0.15 | 0.43 | 0.46 | 319 |
| XM_030906 | 0.01 | 0.18 | 0.45 | 0.28 | 0.39 | 320 |
| NM_004834 | 0.00 | −0.68 | −0.41 | 0.27 | 0.35 | 321 |
| XM_031287 | 0.01 | 0.11 | 0.38 | 0.27 | 0.41 | 322 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| AI923251 | 0.00 | −0.25 | 0.02 | 0.20 | 0.24 | 323 |
| AI203697 | 0.00 | −0.22 | 0.05 | 0.31 | 0.18 | 324 |
| AA621192 | 0.02 | 0.04 | 0.31 | 0.34 | 0.45 | 325 |
| XM_008450 | 0.02 | −0.24 | 0.03 | 0.51 | 0.29 | 326 |
| AI540674 | 0.00 | −0.76 | −0.49 | 0.25 | 0.34 | 327 |
| AA514237 | 0.03 | 0.35 | 0.62 | 0.31 | 0.47 | 328 |
| AI348271 | 0.01 | −0.11 | 0.16 | 0.45 | 0.26 | 329 |
| NM_000684.1 | 0.02 | 0.41 | 0.68 | 0.29 | 0.44 | 330 |
| NM_001951 | 0.03 | −0.67 | −0.40 | 0.50 | 0.40 | 331 |
| N55249 | 0.01 | −0.42 | −0.15 | 0.45 | 0.31 | 332 |
| AI150732 | 0.01 | −0.20 | 0.07 | 0.34 | 0.34 | 333 |
| AI147315 | 0.03 | 0.35 | 0.62 | 0.38 | 0.45 | 334 |
| NM_003010 | 0.00 | −0.46 | −0.20 | 0.34 | 0.25 | 335 |
| AA460460 | 0.01 | −0.22 | 0.05 | 0.47 | 0.28 | 336 |
| AI651337 | 0.01 | −0.49 | −0.22 | 0.41 | 0.31 | 337 |
| AA971087 | 0.01 | −0.19 | 0.08 | 0.42 | 0.25 | 338 |
| NM_003811 | 0.03 | −1.09 | −0.82 | 0.50 | 0.37 | 339 |
| XM_053519 | 0.01 | −0.30 | −0.04 | 0.26 | 0.39 | 340 |
| NM_001609.1 | 0.00 | −0.24 | 0.03 | 0.29 | 0.29 | 341 |
| AA463423 | 0.00 | −0.17 | 0.09 | 0.22 | 0.35 | 342 |
| AA648848 | 0.02 | 0.04 | 0.30 | 0.35 | 0.42 | 343 |
| AI141692 | 0.05 | −0.12 | 0.14 | 0.67 | 0.22 | 344 |
| R79239 | 0.04 | 0.06 | 0.33 | 0.50 | 0.42 | 345 |
| AI298171 | 0.00 | −0.28 | −0.01 | 0.17 | 0.21 | 346 |
| H17432 | 0.03 | −0.29 | −0.03 | 0.57 | 0.23 | 347 |
| NM_004635 | 0.05 | −1.36 | −1.10 | 0.31 | 0.51 | 348 |
| NM_005409 | 0.02 | 0.14 | 0.40 | 0.20 | 0.50 | 349 |
| AI452845 | 0.03 | 0.23 | 0.49 | 0.37 | 0.43 | 350 |
| AI222914 | 0.00 | −0.03 | 0.23 | 0.29 | 0.24 | 351 |
| AI885492 | 0.00 | −0.06 | 0.20 | 0.34 | 0.20 | 352 |
| NM_002953 | 0.01 | −0.61 | −0.35 | 0.24 | 0.41 | 353 |
| AI201175 | 0.01 | 0.25 | 0.51 | 0.30 | 0.33 | 354 |
| NM_001735 | 0.02 | −0.45 | −0.20 | 0.47 | 0.29 | 355 |
| D78151 | 0.02 | −0.70 | −0.44 | 0.42 | 0.34 | 356 |
| NM_006712 | 0.00 | −0.20 | 0.06 | 0.36 | 0.24 | 357 |
| AF004429 | 0.00 | −0.63 | −0.37 | 0.29 | 0.29 | 358 |
| NM_031409 | 0.03 | 0.19 | 0.44 | 0.32 | 0.45 | 359 |
| AI742287 | 0.01 | −0.30 | −0.04 | 0.41 | 0.27 | 360 |
| BC015542 | 0.02 | −0.42 | −0.16 | 0.34 | 0.42 | 361 |
| AI685923 | 0.00 | −0.43 | −0.18 | 0.32 | 0.22 | 362 |
| NM_002218.1 | 0.01 | −0.55 | −0.29 | 0.34 | 0.28 | 363 |
| XM_003913 | 0.00 | −0.05 | 0.20 | 0.29 | 0.29 | 364 |
| N53480 | 0.02 | −0.64 | −0.39 | 0.40 | 0.38 | 365 |
| XM_048511 | 0.00 | −0.35 | −0.10 | 0.37 | 0.25 | 366 |
| R06710 | 0.02 | 0.05 | 0.30 | 0.39 | 0.35 | 367 |
| AI694720 | 0.01 | 0.29 | 0.54 | 0.28 | 0.34 | 368 |
| AI910988 | 0.00 | 0.07 | 0.32 | 0.23 | 0.33 | 369 |
| AA411624 | 0.02 | −0.52 | −0.27 | 0.33 | 0.38 | 370 |
| BC024270 | 0.00 | −0.43 | −0.18 | 0.32 | 0.27 | 371 |
| T90460 | 0.01 | −0.39 | −0.14 | 0.48 | 0.17 | 372 |
| NM_004850 | 0.02 | −0.92 | −0.67 | 0.41 | 0.32 | 373 |
| AA044390 | 0.03 | −0.01 | 0.24 | 0.26 | 0.45 | 374 |
| NM_005347.2 | 0.00 | −0.26 | −0.01 | 0.21 | 0.23 | 375 |
| XM_027216 | 0.03 | −0.68 | −0.43 | 0.42 | 0.39 | 376 |
| H53259 | 0.04 | 0.45 | 0.70 | 0.35 | 0.45 | 377 |
| R26717 | 0.02 | −0.02 | 0.22 | 0.40 | 0.35 | 378 |
| AI912970 | 0.02 | 0.19 | 0.44 | 0.36 | 0.35 | 379 |
| XM_001687 | 0.04 | −0.91 | −0.66 | 0.44 | 0.40 | 380 |
| NM_000565 | 0.04 | −0.67 | −0.43 | 0.27 | 0.50 | 381 |
| AI374990 | 0.01 | −0.14 | 0.10 | 0.31 | 0.35 | 382 |
| N22563 | 0.02 | 0.12 | 0.37 | 0.33 | 0.39 | 383 |
| AI764969 | 0.03 | −0.18 | 0.07 | 0.53 | 0.25 | 384 |
| AA417950 | 0.02 | −0.34 | −0.09 | 0.48 | 0.26 | 385 |
| H15431 | 0.03 | −0.39 | −0.14 | 0.51 | 0.30 | 386 |
| AI147997 | 0.02 | 0.11 | 0.35 | 0.24 | 0.45 | 387 |
| AI378142 | 0.03 | −0.10 | 0.14 | 0.25 | 0.42 | 388 |
| AA528101 | 0.00 | −0.43 | −0.19 | 0.32 | 0.21 | 389 |
| T83761 | 0.04 | −0.41 | −0.16 | 0.36 | 0.46 | 390 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| XM_046674 | 0.04 | −0.80 | −0.56 | 0.59 | 0.21 | 391 |
| AI925556 | 0.00 | −0.53 | −0.29 | 0.24 | 0.21 | 392 |
| N50785 | 0.03 | 0.25 | 0.49 | 0.29 | 0.43 | 393 |
| AI739085 | 0.04 | −0.41 | −0.17 | 0.41 | 0.39 | 394 |
| AA885052 | 0.02 | −0.13 | 0.11 | 0.42 | 0.28 | 395 |
| R45218 | 0.01 | 0.17 | 0.41 | 0.25 | 0.37 | 396 |
| N71365 | 0.00 | −0.39 | −0.15 | 0.22 | 0.33 | 397 |
| AI590053 | 0.00 | −0.38 | −0.14 | 0.19 | 0.16 | 398 |
| NM_013229 | 0.00 | 0.02 | 0.26 | 0.22 | 0.26 | 399 |
| NM_001196 | 0.02 | −0.53 | −0.30 | 0.27 | 0.39 | 400 |
| R94509 | 0.01 | 0.07 | 0.31 | 0.29 | 0.29 | 401 |
| AA282936 | 0.02 | 0.16 | 0.39 | 0.41 | 0.33 | 402 |
| NM_003824 | 0.01 | −0.74 | −0.50 | 0.26 | 0.37 | 403 |
| T65296 | 0.01 | 0.00 | 0.23 | 0.23 | 0.34 | 404 |
| AI583064 | 0.03 | 0.01 | 0.24 | 0.28 | 0.42 | 405 |
| R94626 | 0.01 | −0.25 | −0.01 | 0.25 | 0.35 | 406 |
| AI216612 | 0.03 | −0.20 | 0.03 | 0.42 | 0.35 | 407 |
| NM_015318.1 | 0.01 | −0.12 | 0.11 | 0.32 | 0.25 | 408 |
| AA426397 | 0.02 | −0.37 | −0.14 | 0.33 | 0.34 | 409 |
| H78362 | 0.01 | −0.53 | −0.30 | 0.31 | 0.27 | 410 |
| AA878269 | 0.02 | −0.28 | −0.05 | 0.32 | 0.34 | 411 |
| NM_017778 | 0.01 | −0.17 | 0.06 | 0.39 | 0.26 | 412 |
| AI709236 | 0.00 | −0.24 | −0.01 | 0.21 | 0.28 | 413 |
| AA465175 | 0.01 | −0.11 | 0.12 | 0.32 | 0.27 | 414 |
| AI798573 | 0.00 | −0.34 | −0.12 | 0.18 | 0.21 | 415 |
| NM_139070 | 0.02 | −0.87 | −0.64 | 0.41 | 0.27 | 416 |
| XM_049749 | 0.04 | −0.18 | 0.05 | 0.50 | 0.28 | 417 |
| AI864931 | 0.01 | 0.09 | 0.31 | 0.24 | 0.31 | 418 |
| NM_021975 | 0.00 | −0.63 | −0.41 | 0.29 | 0.22 | 419 |
| R60931 | 0.03 | 0.16 | 0.39 | 0.35 | 0.35 | 420 |
| XM_037260 | 0.00 | −0.38 | −0.15 | 0.18 | 0.26 | 421 |
| R36650 | 0.00 | −0.40 | −0.17 | 0.23 | 0.25 | 422 |
| AA621075 | 0.00 | −0.31 | −0.09 | 0.24 | 0.28 | 423 |
| AI018273 | 0.04 | −0.23 | 0.00 | 0.45 | 0.31 | 424 |
| AI701905 | 0.00 | −0.24 | −0.01 | 0.22 | 0.24 | 425 |
| XM_054686 | 0.02 | −0.55 | −0.33 | 0.30 | 0.31 | 426 |
| NM_139276 | 0.02 | −0.09 | 0.14 | 0.25 | 0.38 | 427 |
| AI418064 | 0.01 | −0.23 | −0.01 | 0.32 | 0.24 | 428 |
| NM_002503 | 0.03 | −0.50 | −0.28 | 0.40 | 0.32 | 429 |
| AI923559 | 0.02 | −0.37 | −0.15 | 0.35 | 0.33 | 430 |
| NM_004295 | 0.04 | −0.66 | −0.44 | 0.40 | 0.37 | 431 |
| AA425105 | 0.03 | −0.19 | 0.04 | 0.43 | 0.29 | 432 |
| NM_002997 | 0.02 | 0.01 | 0.24 | 0.37 | 0.28 | 433 |
| NM_024013 | 0.00 | 0.04 | 0.27 | 0.28 | 0.23 | 434 |
| AA856755 | 0.02 | −0.40 | −0.18 | 0.34 | 0.34 | 435 |
| AI371339 | 0.00 | −0.28 | −0.06 | 0.24 | 0.22 | 436 |
| AA453528 | 0.04 | −0.30 | −0.08 | 0.50 | 0.27 | 437 |
| AI214646 | 0.04 | −0.27 | −0.05 | 0.24 | 0.43 | 438 |
| NM_006724 | 0.01 | −0.45 | −0.22 | 0.32 | 0.24 | 439 |
| AI925740 | 0.02 | 0.02 | 0.24 | 0.42 | 0.25 | 440 |
| H81378 | 0.00 | −0.16 | 0.06 | 0.32 | 0.19 | 441 |
| H82860 | 0.03 | 0.01 | 0.23 | 0.25 | 0.41 | 442 |
| BC032713 | 0.02 | 0.39 | 0.61 | 0.22 | 0.37 | 443 |
| H10036 | 0.05 | −0.08 | 0.13 | 0.42 | 0.35 | 444 |
| AI707917 | 0.00 | −0.34 | −0.12 | 0.18 | 0.20 | 445 |
| AA676928 | 0.05 | −0.04 | 0.18 | 0.36 | 0.40 | 446 |
| AI057616 | 0.00 | −0.03 | 0.19 | 0.19 | 0.30 | 447 |
| NM_003080 | 0.01 | −0.03 | 0.18 | 0.29 | 0.25 | 448 |
| AI685198 | 0.00 | −0.41 | −0.20 | 0.19 | 0.23 | 449 |
| AA436683 | 0.02 | −0.16 | 0.05 | 0.34 | 0.29 | 450 |
| R39456 | 0.00 | −0.34 | −0.13 | 0.17 | 0.23 | 451 |
| NM_004050 | 0.03 | −0.23 | −0.02 | 0.38 | 0.31 | 452 |
| N49208 | 0.02 | 0.13 | 0.34 | 0.35 | 0.32 | 453 |
| XM_055699 | 0.05 | 0.02 | 0.23 | 0.36 | 0.39 | 454 |
| BC028234 | 0.02 | −0.45 | −0.24 | 0.26 | 0.37 | 455 |
| N89900 | 0.02 | −0.39 | −0.18 | 0.36 | 0.28 | 456 |
| NM_001278 | 0.00 | −0.63 | −0.42 | 0.22 | 0.21 | 457 |
| AI921613 | 0.01 | −0.06 | 0.16 | 0.25 | 0.26 | 458 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| NM_003821 | 0.03 | −0.64 | −0.43 | 0.43 | 0.23 | 459 |
| XM_046035 | 0.00 | −0.37 | −0.16 | 0.20 | 0.27 | 460 |
| AI936300 | 0.04 | 0.08 | 0.29 | 0.30 | 0.39 | 461 |
| NM_003131 | 0.00 | −0.71 | −0.50 | 0.30 | 0.21 | 462 |
| R61546 | 0.01 | −0.52 | −0.31 | 0.30 | 0.25 | 463 |
| AA431750 | 0.02 | −0.24 | −0.03 | 0.32 | 0.29 | 464 |
| AI524099 | 0.00 | −0.03 | 0.18 | 0.15 | 0.20 | 465 |
| XM_042665 | 0.00 | 0.07 | 0.28 | 0.25 | 0.22 | 466 |
| AI820873 | 0.02 | −0.48 | −0.27 | 0.39 | 0.24 | 467 |
| NM_019011 | 0.02 | −0.60 | −0.39 | 0.27 | 0.35 | 468 |
| H51585 | 0.05 | −0.57 | −0.36 | 0.42 | 0.30 | 469 |
| AI393173 | 0.02 | −0.04 | 0.16 | 0.25 | 0.34 | 470 |
| AI560205 | 0.00 | −0.36 | −0.15 | 0.19 | 0.23 | 471 |
| AA429020 | 0.00 | −0.31 | −0.11 | 0.20 | 0.17 | 472 |
| NM_000681.2 | 0.01 | 0.14 | 0.34 | 0.30 | 0.27 | 473 |
| NM_014550 | 0.00 | −0.10 | 0.10 | 0.25 | 0.16 | 474 |
| AA453256 | 0.00 | −0.04 | 0.16 | 0.20 | 0.26 | 475 |
| NM_021138 | 0.00 | −0.23 | −0.03 | 0.28 | 0.14 | 476 |
| R51304 | 0.05 | −0.02 | 0.19 | 0.32 | 0.38 | 477 |
| AI590111 | 0.00 | −0.31 | −0.10 | 0.14 | 0.20 | 478 |
| H09305 | 0.01 | −0.57 | −0.37 | 0.31 | 0.26 | 479 |
| R99076 | 0.00 | −0.40 | −0.19 | 0.19 | 0.22 | 480 |
| AI559096 | 0.01 | 0.28 | 0.48 | 0.29 | 0.29 | 481 |
| AI610213 | 0.02 | −0.12 | 0.08 | 0.34 | 0.27 | 482 |
| N66038 | 0.00 | −0.33 | −0.12 | 0.17 | 0.20 | 483 |
| NM_002649 | 0.00 | −0.33 | −0.13 | 0.17 | 0.29 | 484 |
| NM_006676 | 0.02 | −0.54 | −0.34 | 0.32 | 0.27 | 485 |
| NM_014959 | 0.00 | −0.38 | −0.18 | 0.24 | 0.25 | 486 |
| BC013992 | 0.01 | 0.01 | 0.21 | 0.16 | 0.32 | 487 |
| N32057 | 0.02 | −0.34 | −0.14 | 0.39 | 0.20 | 488 |
| AI801695 | 0.00 | −0.33 | −0.13 | 0.17 | 0.18 | 489 |
| AI568793 | 0.03 | 0.11 | 0.31 | 0.29 | 0.33 | 490 |
| AA479285 | 0.00 | 0.08 | 0.27 | 0.23 | 0.23 | 491 |
| H06501 | 0.02 | −0.10 | 0.10 | 0.32 | 0.28 | 492 |
| R00259 | 0.03 | −0.06 | 0.14 | 0.31 | 0.32 | 493 |
| AI362368 | 0.00 | −0.33 | −0.13 | 0.17 | 0.19 | 494 |
| AI635040 | 0.00 | −0.14 | 0.06 | 0.18 | 0.26 | 495 |
| AI354869 | 0.03 | −0.48 | −0.29 | 0.32 | 0.26 | 496 |
| N71407 | 0.02 | 0.06 | 0.25 | 0.26 | 0.32 | 497 |
| XM_038544 | 0.04 | −0.12 | 0.07 | 0.38 | 0.29 | 498 |
| NM_031910 | 0.04 | 0.18 | 0.38 | 0.27 | 0.38 | 499 |
| AI862063 | 0.00 | −0.28 | −0.08 | 0.20 | 0.24 | 500 |
| AA455638 | 0.03 | 0.07 | 0.27 | 0.28 | 0.32 | 501 |
| AI697430 | 0.00 | −0.36 | −0.17 | 0.18 | 0.21 | 502 |
| R42480 | 0.01 | −0.49 | −0.29 | 0.25 | 0.23 | 503 |
| AI674115 | 0.01 | 0.02 | 0.21 | 0.24 | 0.29 | 504 |
| AA968926 | 0.03 | −0.32 | −0.13 | 0.37 | 0.26 | 505 |
| AI524694 | 0.00 | −0.38 | −0.19 | 0.18 | 0.23 | 506 |
| AA609857 | 0.02 | −0.08 | 0.12 | 0.30 | 0.29 | 507 |
| AI913713 | 0.01 | −0.46 | −0.27 | 0.33 | 0.21 | 508 |
| W04695 | 0.00 | −0.28 | −0.09 | 0.16 | 0.24 | 509 |
| NM_033012 | 0.04 | −0.12 | 0.07 | 0.35 | 0.31 | 510 |
| T77048 | 0.02 | −0.01 | 0.18 | 0.26 | 0.31 | 511 |
| AI817381 | 0.01 | −0.25 | −0.06 | 0.23 | 0.24 | 512 |
| AI624918 | 0.03 | −0.02 | 0.17 | 0.28 | 0.32 | 513 |
| AI888072 | 0.01 | −0.26 | −0.07 | 0.23 | 0.26 | 514 |
| AA883759 | 0.00 | −0.38 | −0.20 | 0.21 | 0.22 | 515 |
| AA478611 | 0.00 | −0.34 | −0.15 | 0.25 | 0.17 | 516 |
| AI452862 | 0.03 | −0.28 | −0.09 | 0.34 | 0.26 | 517 |
| AI277955 | 0.00 | −0.46 | −0.27 | 0.24 | 0.22 | 518 |
| AI520967 | 0.00 | −0.34 | −0.15 | 0.17 | 0.20 | 519 |
| T91937 | 0.05 | 0.36 | 0.54 | 0.27 | 0.37 | 520 |
| AA993698 | 0.00 | 0.01 | 0.20 | 0.21 | 0.20 | 521 |
| AI620374 | 0.00 | −0.40 | −0.22 | 0.18 | 0.22 | 522 |
| AA707628 | 0.00 | −0.27 | −0.08 | 0.12 | 0.17 | 523 |
| AI572545 | 0.01 | −0.38 | −0.19 | 0.17 | 0.28 | 524 |
| AI801540 | 0.04 | −0.16 | 0.03 | 0.36 | 0.28 | 525 |
| AI354889 | 0.00 | −0.11 | 0.07 | 0.22 | 0.18 | 526 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| NM_030751 | 0.03 | −0.09 | 0.09 | 0.33 | 0.25 | 527 |
| NM_000657 | 0.01 | −0.50 | −0.32 | 0.27 | 0.22 | 528 |
| AA045139 | 0.02 | −0.43 | −0.24 | 0.34 | 0.23 | 529 |
| AI912148 | 0.00 | −0.25 | −0.06 | 0.18 | 0.20 | 530 |
| AA513806 | 0.04 | −0.21 | −0.03 | 0.29 | 0.32 | 531 |
| H48440 | 0.00 | −0.35 | −0.17 | 0.16 | 0.23 | 532 |
| AA114117 | 0.00 | −0.38 | −0.20 | 0.17 | 0.18 | 533 |
| AI654471 | 0.00 | −0.20 | −0.02 | 0.19 | 0.20 | 534 |
| AA423792 | 0.00 | −0.16 | 0.02 | 0.14 | 0.25 | 535 |
| AI926484 | 0.00 | −0.08 | 0.10 | 0.25 | 0.14 | 536 |
| T89979 | 0.00 | −0.30 | −0.12 | 0.16 | 0.19 | 537 |
| AI889310 | 0.01 | −0.25 | −0.07 | 0.26 | 0.21 | 538 |
| R11261 | 0.04 | −0.27 | −0.09 | 0.43 | 0.18 | 539 |
| AI932551 | 0.00 | −0.32 | −0.14 | 0.16 | 0.23 | 540 |
| NM_017626.1 | 0.01 | −0.56 | −0.38 | 0.22 | 0.26 | 541 |
| AI381513 | 0.04 | −0.29 | −0.11 | 0.32 | 0.29 | 542 |
| AA682407 | 0.02 | −0.24 | −0.07 | 0.25 | 0.29 | 543 |
| AA954316 | 0.04 | −0.75 | −0.57 | 0.35 | 0.27 | 544 |
| AI791500 | 0.02 | 0.16 | 0.34 | 0.18 | 0.31 | 545 |
| T91881 | 0.00 | −0.26 | −0.08 | 0.18 | 0.23 | 546 |
| AI149857 | 0.02 | −0.06 | 0.12 | 0.18 | 0.30 | 547 |
| AI370842 | 0.04 | 0.11 | 0.29 | 0.31 | 0.30 | 548 |
| AA401205 | 0.00 | −0.13 | 0.05 | 0.18 | 0.19 | 549 |
| AA453267 | 0.02 | −0.03 | 0.15 | 0.26 | 0.28 | 550 |
| R88475 | 0.00 | −0.35 | −0.17 | 0.18 | 0.20 | 551 |
| AI864919 | 0.01 | −0.38 | −0.20 | 0.19 | 0.25 | 552 |
| NM_002169 | 0.04 | −0.24 | −0.07 | 0.33 | 0.27 | 553 |
| R46801 | 0.05 | 0.27 | 0.44 | 0.35 | 0.27 | 554 |
| AI277856 | 0.02 | −0.12 | 0.06 | 0.22 | 0.27 | 555 |
| H22921 | 0.00 | −0.33 | −0.15 | 0.19 | 0.22 | 556 |
| AI763386 | 0.03 | −0.37 | −0.20 | 0.30 | 0.27 | 557 |
| N78812 | 0.01 | −0.23 | −0.06 | 0.25 | 0.20 | 558 |
| H83981 | 0.04 | 0.04 | 0.22 | 0.28 | 0.30 | 559 |
| AA029887 | 0.00 | −0.40 | −0.22 | 0.19 | 0.21 | 560 |
| AI192112 | 0.00 | −0.11 | 0.06 | 0.15 | 0.24 | 561 |
| W88960 | 0.01 | 0.10 | 0.28 | 0.21 | 0.24 | 562 |
| W80744 | 0.00 | −0.25 | −0.08 | 0.15 | 0.21 | 563 |
| AI521577 | 0.01 | −0.31 | −0.13 | 0.18 | 0.23 | 564 |
| AA418572 | 0.01 | −0.13 | 0.05 | 0.17 | 0.25 | 565 |
| N73510 | 0.00 | −0.38 | −0.21 | 0.17 | 0.22 | 566 |
| AI631299 | 0.03 | −0.16 | 0.01 | 0.24 | 0.29 | 567 |
| XM_012717 | 0.00 | −0.44 | −0.27 | 0.18 | 0.17 | 568 |
| NM_000590 | 0.03 | 0.32 | 0.50 | 0.23 | 0.29 | 569 |
| AI381910 | 0.01 | −0.04 | 0.13 | 0.21 | 0.23 | 570 |
| R87714 | 0.04 | −0.18 | −0.01 | 0.33 | 0.23 | 571 |
| AA609628 | 0.00 | −0.36 | −0.19 | 0.17 | 0.19 | 572 |
| AA634317 | 0.03 | 0.19 | 0.36 | 0.27 | 0.28 | 573 |
| AI214830 | 0.04 | −0.27 | −0.10 | 0.23 | 0.32 | 574 |
| AI203201 | 0.04 | −0.26 | −0.09 | 0.26 | 0.29 | 575 |
| AI924806 | 0.00 | −0.29 | −0.12 | 0.20 | 0.18 | 576 |
| AA701319 | 0.02 | −0.07 | 0.10 | 0.22 | 0.28 | 577 |
| N63628 | 0.03 | −0.26 | −0.09 | 0.26 | 0.27 | 578 |
| R02742 | 0.04 | −0.17 | −0.01 | 0.32 | 0.25 | 579 |
| H07860 | 0.02 | −0.03 | 0.13 | 0.26 | 0.24 | 580 |
| H77534 | 0.02 | −0.35 | −0.18 | 0.32 | 0.20 | 581 |
| AI208537 | 0.02 | −0.21 | −0.04 | 0.34 | 0.17 | 582 |
| AI184715 | 0.01 | −0.03 | 0.13 | 0.23 | 0.20 | 583 |
| R05816 | 0.00 | −0.27 | −0.10 | 0.19 | 0.20 | 584 |
| AA961252 | 0.04 | −0.14 | 0.02 | 0.26 | 0.31 | 585 |
| AI801425 | 0.00 | −0.21 | −0.04 | 0.22 | 0.17 | 586 |
| AA477776 | 0.01 | −0.01 | 0.16 | 0.21 | 0.20 | 587 |
| R06585 | 0.01 | −0.40 | −0.23 | 0.18 | 0.21 | 588 |
| AA405788 | 0.01 | −0.36 | −0.19 | 0.15 | 0.25 | 589 |
| R06107 | 0.01 | −0.23 | −0.07 | 0.24 | 0.19 | 590 |
| AA923316 | 0.00 | −0.20 | −0.04 | 0.15 | 0.19 | 591 |
| AI421397 | 0.02 | −0.02 | 0.14 | 0.19 | 0.26 | 592 |
| NM_006881 | 0.01 | −0.40 | −0.24 | 0.20 | 0.23 | 593 |
| R43415 | 0.00 | −0.24 | −0.08 | 0.14 | 0.19 | 594 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| H11495 | 0.01 | −0.29 | −0.12 | 0.26 | 0.13 | 595 |
| AI208772 | 0.04 | −0.23 | −0.07 | 0.29 | 0.27 | 596 |
| AA479784 | 0.03 | −0.06 | 0.10 | 0.29 | 0.24 | 597 |
| AA485092 | 0.00 | −0.36 | −0.20 | 0.16 | 0.20 | 598 |
| AA664688 | 0.00 | −0.39 | −0.23 | 0.18 | 0.20 | 599 |
| H48230 | 0.01 | −0.29 | −0.13 | 0.19 | 0.21 | 600 |
| AI248075 | 0.02 | −0.12 | 0.04 | 0.25 | 0.22 | 601 |
| AA418695 | 0.04 | −0.01 | 0.15 | 0.21 | 0.31 | 602 |
| AI673731 | 0.01 | −0.41 | −0.25 | 0.16 | 0.22 | 603 |
| XM_008948 | 0.03 | 0.10 | 0.26 | 0.26 | 0.26 | 604 |
| AI301257 | 0.00 | −0.31 | −0.15 | 0.19 | 0.19 | 605 |
| NM_003823 | 0.04 | −0.72 | −0.56 | 0.31 | 0.24 | 606 |
| AI744264 | 0.01 | −0.14 | 0.02 | 0.16 | 0.22 | 607 |
| AI809873 | 0.03 | −0.45 | −0.29 | 0.24 | 0.26 | 608 |
| AI354243 | 0.01 | −0.34 | −0.18 | 0.17 | 0.21 | 609 |
| NM_001553.1 | 0.04 | −0.15 | 0.01 | 0.27 | 0.27 | 610 |
| W86575 | 0.02 | −0.34 | −0.18 | 0.23 | 0.24 | 611 |
| AA442720 | 0.03 | −0.15 | 0.01 | 0.27 | 0.24 | 612 |
| AA993597 | 0.03 | 0.17 | 0.33 | 0.26 | 0.24 | 613 |
| AI433952 | 0.01 | −0.30 | −0.14 | 0.16 | 0.23 | 614 |
| R56800 | 0.01 | −0.09 | 0.06 | 0.17 | 0.21 | 615 |
| AA417031 | 0.01 | −0.21 | −0.06 | 0.19 | 0.23 | 616 |
| R53961 | 0.04 | −0.45 | −0.29 | 0.28 | 0.25 | 617 |
| T86887 | 0.00 | −0.23 | −0.08 | 0.13 | 0.20 | 618 |
| AA705808 | 0.01 | −0.20 | −0.04 | 0.25 | 0.18 | 619 |
| AA426451 | 0.00 | −0.28 | −0.13 | 0.16 | 0.19 | 620 |
| H06263 | 0.00 | −0.28 | −0.12 | 0.14 | 0.17 | 621 |
| AA659421 | 0.00 | −0.32 | −0.17 | 0.14 | 0.16 | 622 |
| AI801595 | 0.00 | −0.28 | −0.13 | 0.16 | 0.19 | 623 |
| AI672318 | 0.04 | −0.20 | −0.05 | 0.31 | 0.24 | 624 |
| AI762019 | 0.01 | −0.25 | −0.09 | 0.19 | 0.21 | 625 |
| N92873 | 0.02 | −0.11 | 0.05 | 0.28 | 0.19 | 626 |
| NM_017442 | 0.04 | 0.08 | 0.23 | 0.28 | 0.25 | 627 |
| H46164 | 0.03 | 0.03 | 0.18 | 0.21 | 0.27 | 628 |
| T83946 | 0.01 | −0.29 | −0.14 | 0.20 | 0.21 | 629 |
| AA868726 | 0.04 | −0.42 | −0.27 | 0.26 | 0.25 | 630 |
| H88129 | 0.02 | −0.37 | −0.22 | 0.21 | 0.23 | 631 |
| R88267 | 0.04 | −0.12 | 0.03 | 0.30 | 0.23 | 632 |
| AI798545 | 0.01 | −0.32 | −0.17 | 0.17 | 0.19 | 633 |
| N57775 | 0.02 | −0.14 | 0.01 | 0.22 | 0.22 | 634 |
| AA425134 | 0.00 | −0.21 | −0.07 | 0.16 | 0.19 | 635 |
| AI744807 | 0.01 | −0.59 | −0.44 | 0.20 | 0.22 | 636 |
| AI702056 | 0.05 | −0.27 | −0.12 | 0.22 | 0.29 | 637 |
| NM_000575 | 0.04 | −0.27 | −0.12 | 0.23 | 0.25 | 638 |
| T98779 | 0.01 | −0.38 | −0.23 | 0.18 | 0.23 | 639 |
| NM_000587 | 0.01 | −0.43 | −0.28 | 0.18 | 0.19 | 640 |
| R92455 | 0.01 | −0.36 | −0.21 | 0.17 | 0.21 | 641 |
| AI758473 | 0.01 | −0.36 | −0.21 | 0.18 | 0.22 | 642 |
| AA398364 | 0.00 | −0.31 | −0.17 | 0.13 | 0.21 | 643 |
| AI811774 | 0.05 | 0.20 | 0.35 | 0.23 | 0.27 | 644 |
| AI299411 | 0.00 | −0.24 | −0.10 | 0.17 | 0.18 | 645 |
| AA225138 | 0.00 | −0.26 | −0.11 | 0.12 | 0.17 | 646 |
| AA418689 | 0.05 | 0.09 | 0.24 | 0.21 | 0.28 | 647 |
| T77995 | 0.01 | −0.18 | −0.04 | 0.21 | 0.20 | 648 |
| AA808788 | 0.04 | −0.33 | −0.18 | 0.18 | 0.25 | 649 |
| AI677645 | 0.01 | −0.25 | −0.11 | 0.15 | 0.19 | 650 |
| AA629306 | 0.04 | −0.07 | 0.07 | 0.26 | 0.24 | 651 |
| AA749151 | 0.00 | −0.19 | −0.05 | 0.13 | 0.17 | 652 |
| AI679294 | 0.01 | −0.41 | −0.27 | 0.19 | 0.19 | 653 |
| R45611 | 0.02 | −0.24 | −0.10 | 0.16 | 0.24 | 654 |
| NM_000588 | 0.05 | −0.18 | −0.04 | 0.29 | 0.22 | 655 |
| H99483 | 0.01 | −0.29 | −0.15 | 0.16 | 0.22 | 656 |
| AI679923 | 0.01 | −0.46 | −0.32 | 0.17 | 0.20 | 657 |
| AI077580 | 0.05 | −0.04 | 0.10 | 0.27 | 0.23 | 658 |
| D49410 | 0.01 | −0.31 | −0.17 | 0.19 | 0.19 | 659 |
| AI692267 | 0.04 | −0.42 | −0.28 | 0.22 | 0.24 | 660 |
| AI804001 | 0.02 | 0.00 | 0.14 | 0.19 | 0.23 | 661 |
| T87188 | 0.01 | −0.32 | −0.18 | 0.19 | 0.19 | 662 |

TABLE 2-continued

Significantly elevated gene activities in samples of patients with infectious MOF, if compared with the gene activities of patients with non-infectious MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| AI368218 | 0.02 | −0.24 | −0.10 | 0.13 | 0.23 | 663 |
| AI208749 | 0.02 | −0.02 | 0.11 | 0.22 | 0.19 | 664 |
| H61046 | 0.02 | −0.21 | −0.07 | 0.18 | 0.22 | 665 |
| NM_001330.1 | 0.01 | −0.05 | 0.08 | 0.19 | 0.20 | 666 |
| XM_001322 | 0.01 | −0.33 | −0.19 | 0.18 | 0.17 | 667 |
| NM_004195 | 0.04 | 0.23 | 0.37 | 0.16 | 0.27 | 668 |
| AI285713 | 0.01 | −0.32 | −0.18 | 0.15 | 0.21 | 669 |
| AA527369 | 0.00 | −0.13 | 0.00 | 0.15 | 0.16 | 670 |
| AI350069 | 0.01 | −0.24 | −0.11 | 0.15 | 0.21 | 671 |
| AI493975 | 0.01 | −0.24 | −0.10 | 0.18 | 0.16 | 672 |
| AI355007 | 0.03 | −0.23 | −0.10 | 0.22 | 0.21 | 673 |
| AA225239 | 0.04 | −0.40 | −0.26 | 0.21 | 0.25 | 674 |
| AA001392 | 0.03 | −0.39 | −0.26 | 0.24 | 0.19 | 675 |
| AI933797 | 0.02 | −0.28 | −0.15 | 0.22 | 0.18 | 676 |
| R43065 | 0.01 | −0.21 | −0.08 | 0.16 | 0.18 | 677 |
| AA478621 | 0.03 | −0.21 | −0.08 | 0.21 | 0.20 | 678 |
| AA012850 | 0.03 | −0.32 | −0.19 | 0.17 | 0.22 | 679 |
| AI925035 | 0.03 | −0.15 | −0.02 | 0.17 | 0.23 | 680 |
| AA995218 | 0.03 | −0.22 | −0.09 | 0.19 | 0.21 | 681 |
| AA897716 | 0.04 | −0.18 | −0.06 | 0.23 | 0.21 | 682 |
| AA983987 | 0.02 | −0.28 | −0.15 | 0.18 | 0.18 | 683 |
| AI762202 | 0.03 | −0.18 | −0.05 | 0.22 | 0.20 | 684 |
| T95909 | 0.02 | −0.34 | −0.22 | 0.18 | 0.19 | 685 |
| N22551 | 0.03 | −0.36 | −0.24 | 0.17 | 0.22 | 686 |
| AI769053 | 0.03 | −0.28 | −0.15 | 0.15 | 0.22 | 687 |
| AF039955 | 0.01 | −0.37 | −0.24 | 0.20 | 0.16 | 688 |
| AI935874 | 0.02 | −0.26 | −0.14 | 0.16 | 0.20 | 689 |
| AI570779 | 0.01 | −0.31 | −0.19 | 0.15 | 0.18 | 690 |
| AI240539 | 0.01 | −0.22 | −0.09 | 0.17 | 0.18 | 691 |
| H54423 | 0.03 | −0.32 | −0.20 | 0.16 | 0.22 | 692 |
| AA460136 | 0.02 | −0.09 | 0.03 | 0.24 | 0.14 | 693 |
| NM_033357 | 0.05 | −0.24 | −0.12 | 0.19 | 0.23 | 694 |
| AI923479 | 0.04 | −0.30 | −0.18 | 0.20 | 0.22 | 695 |
| H18944 | 0.04 | −0.42 | −0.30 | 0.21 | 0.19 | 696 |
| NM_006509 | 0.03 | 0.01 | 0.13 | 0.12 | 0.23 | 697 |
| AI865298 | 0.02 | −0.31 | −0.19 | 0.13 | 0.20 | 698 |
| AI123502 | 0.04 | −0.36 | −0.24 | 0.17 | 0.22 | 699 |
| AI885918 | 0.02 | −0.24 | −0.12 | 0.14 | 0.19 | 700 |
| AA225023 | 0.02 | −0.33 | −0.21 | 0.12 | 0.20 | 701 |
| AA421020 | 0.04 | −0.25 | −0.13 | 0.19 | 0.21 | 702 |
| AJ297560 | 0.05 | −0.29 | −0.17 | 0.21 | 0.20 | 703 |
| N95217 | 0.02 | −0.30 | −0.19 | 0.12 | 0.19 | 704 |
| AA526032 | 0.04 | −0.25 | −0.13 | 0.20 | 0.19 | 705 |
| AA496309 | 0.02 | −0.32 | −0.20 | 0.15 | 0.19 | 706 |
| AI732958 | 0.03 | −0.22 | −0.11 | 0.18 | 0.18 | 707 |
| AA410828 | 0.02 | −0.29 | −0.18 | 0.20 | 0.16 | 708 |
| AA453993 | 0.02 | −0.30 | −0.19 | 0.18 | 0.16 | 709 |
| R92993 | 0.02 | −0.26 | −0.15 | 0.12 | 0.19 | 710 |
| NM_003921 | 0.04 | −0.23 | −0.13 | 0.20 | 0.18 | 711 |
| AI379967 | 0.02 | −0.34 | −0.23 | 0.15 | 0.17 | 712 |
| AI926656 | 0.04 | −0.26 | −0.15 | 0.18 | 0.19 | 713 |
| AA935872 | 0.03 | −0.31 | −0.20 | 0.16 | 0.18 | 714 |
| H08791 | 0.03 | −0.27 | −0.17 | 0.16 | 0.18 | 715 |
| AI932884 | 0.03 | −0.31 | −0.21 | 0.16 | 0.18 | 716 |
| AI926745 | 0.03 | −0.33 | −0.22 | 0.18 | 0.16 | 717 |
| R99595 | 0.05 | −0.29 | −0.19 | 0.16 | 0.20 | 718 |
| AI824579 | 0.03 | −0.31 | −0.21 | 0.13 | 0.18 | 719 |
| AA427886 | 0.03 | −0.27 | −0.17 | 0.14 | 0.16 | 720 |
| H42488 | 0.04 | −0.33 | −0.24 | 0.16 | 0.15 | 721 |

TABLE 3

Significantly under-expressed gene activities in samples of patients with infectious MODS/MOF, if compared with the gene activities of patients with non-infectious MODS/MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| NM_019111 | 0.00 | 1.41 | 0.21 | 0.73 | 0.56 | 722 |
| N29761 | 0.00 | −0.25 | −1.35 | 0.61 | 0.92 | 723 |
| NM_002124 | 0.00 | 1.60 | 0.54 | 0.62 | 0.52 | 724 |
| R43910 | 0.00 | 2.51 | 1.49 | 1.25 | 0.88 | 725 |
| NM_000570 | 0.00 | 3.66 | 2.67 | 0.70 | 1.31 | 726 |
| NM_002923 | 0.00 | 2.03 | 1.07 | 0.83 | 0.89 | 727 |
| X00457 | 0.00 | 1.46 | 0.50 | 0.84 | 0.60 | 728 |
| NM_022555 | 0.00 | 1.86 | 0.91 | 0.58 | 0.54 | 729 |
| NM_002125 | 0.00 | 1.38 | 0.46 | 0.55 | 0.45 | 730 |
| AA620760 | 0.00 | 0.30 | −0.62 | 0.47 | 0.60 | 731 |
| NM_000569 | 0.01 | 3.13 | 2.26 | 0.86 | 1.21 | 732 |
| NM_021983 | 0.00 | 1.38 | 0.52 | 0.48 | 0.41 | 733 |
| R43203 | 0.00 | 2.03 | 1.18 | 1.16 | 0.74 | 734 |
| NM_033554 | 0.00 | 1.42 | 0.60 | 0.60 | 0.52 | 735 |
| AA626239 | 0.00 | 0.15 | −0.65 | 0.74 | 0.73 | 736 |
| NM_007328 | 0.00 | −0.31 | −1.10 | 0.49 | 0.64 | 737 |
| M90746 | 0.02 | 3.67 | 2.89 | 0.74 | 1.37 | 738 |
| T91086 | 0.00 | −0.81 | −1.59 | 0.63 | 0.67 | 739 |
| AA151104 | 0.00 | 0.11 | −0.64 | 0.46 | 0.46 | 740 |
| H45298 | 0.01 | 1.84 | 1.09 | 0.90 | 0.97 | 741 |
| NM_031311 | 0.00 | 0.78 | 0.03 | 0.52 | 0.39 | 742 |
| AI590144 | 0.00 | 1.70 | 0.96 | 0.97 | 0.70 | 743 |
| NM_001824.2 | 0.00 | 1.63 | 0.88 | 0.58 | 0.67 | 744 |
| NM_018643 | 0.00 | 1.70 | 0.96 | 0.54 | 0.66 | 745 |
| AA400790 | 0.00 | 0.93 | 0.20 | 0.59 | 0.52 | 746 |
| NM_001251 | 0.00 | 1.18 | 0.47 | 0.42 | 0.48 | 747 |
| NM_000887.2 | 0.00 | 0.24 | −0.48 | 0.92 | 0.61 | 748 |
| AI696291 | 0.00 | 0.74 | 0.04 | 0.64 | 0.39 | 749 |
| NM_031477 | 0.02 | 1.89 | 1.19 | 1.02 | 1.06 | 750 |
| AA910846 | 0.00 | 1.29 | 0.60 | 0.87 | 0.45 | 751 |
| NM_005538 | 0.00 | 1.59 | 0.91 | 0.90 | 0.72 | 752 |
| AA398331 | 0.00 | 0.13 | −0.53 | 0.51 | 0.46 | 753 |
| NM_025139 | 0.04 | −1.79 | −2.41 | 0.75 | 1.17 | 754 |
| AA398611 | 0.00 | 1.16 | 0.54 | 0.77 | 0.43 | 755 |
| NM_006682 | 0.00 | −0.05 | −0.67 | 0.46 | 0.39 | 756 |
| X52473 | 0.00 | 1.71 | 1.09 | 0.59 | 0.74 | 757 |
| AI859777 | 0.01 | −1.02 | −1.63 | 0.87 | 0.77 | 758 |
| H18649 | 0.00 | −0.41 | −1.01 | 0.30 | 0.58 | 759 |
| AI700444 | 0.00 | 1.57 | 0.97 | 0.70 | 0.63 | 760 |
| XM_001472 | 0.00 | −0.36 | −0.95 | 0.61 | 0.59 | 761 |
| XM_049959 | 0.01 | 2.10 | 1.53 | 0.73 | 0.78 | 762 |
| AA863064 | 0.03 | 0.96 | 0.39 | 1.20 | 0.63 | 763 |
| H88328 | 0.01 | −1.27 | −1.84 | 0.73 | 0.69 | 764 |
| R40861 | 0.00 | 0.82 | 0.25 | 0.82 | 0.51 | 765 |
| AI733498 | 0.00 | −0.37 | −0.93 | 0.36 | 0.58 | 766 |
| NM_002621 | 0.01 | 1.16 | 0.61 | 0.63 | 0.70 | 767 |
| AI732971 | 0.00 | 0.46 | −0.09 | 0.55 | 0.35 | 768 |
| AA813145 | 0.00 | 0.48 | −0.07 | 0.40 | 0.41 | 769 |
| NM_004221.2 | 0.02 | 2.05 | 1.51 | 0.75 | 0.79 | 770 |
| AA740907 | 0.00 | 0.05 | −0.49 | 0.44 | 0.32 | 771 |
| NM_032022 | 0.00 | 0.90 | 0.36 | 0.42 | 0.50 | 772 |
| XM_003789 | 0.00 | −0.25 | −0.78 | 0.37 | 0.47 | 773 |
| AI357099 | 0.02 | −1.06 | −1.59 | 0.85 | 0.78 | 774 |
| NM_003937 | 0.00 | −0.43 | −0.95 | 0.44 | 0.44 | 775 |
| NM_002122 | 0.00 | 0.84 | 0.33 | 0.71 | 0.51 | 776 |
| AI625626 | 0.01 | 0.90 | 0.40 | 0.87 | 0.52 | 777 |
| H23819 | 0.00 | 0.97 | 0.46 | 0.62 | 0.47 | 778 |
| AI797009 | 0.01 | 0.64 | 0.14 | 0.85 | 0.57 | 779 |
| XM_031354 | 0.01 | 0.99 | 0.49 | 0.63 | 0.72 | 780 |
| XM_051958 | 0.01 | 1.20 | 0.70 | 0.53 | 0.72 | 781 |
| AI499173 | 0.01 | 0.11 | −0.38 | 0.75 | 0.50 | 782 |
| NM_000591 | 0.00 | 0.92 | 0.43 | 0.50 | 0.55 | 783 |
| NM_057158 | 0.00 | −0.03 | −0.52 | 0.49 | 0.34 | 784 |
| R71775 | 0.00 | 0.42 | −0.07 | 0.61 | 0.55 | 785 |
| AI924028 | 0.00 | −0.35 | −0.84 | 0.36 | 0.58 | 786 |
| R39504 | 0.00 | −0.50 | −0.98 | 0.34 | 0.40 | 787 |
| N66205 | 0.01 | 1.49 | 1.02 | 0.72 | 0.62 | 788 |
| AI738831 | 0.00 | 0.09 | −0.38 | 0.29 | 0.56 | 789 |

TABLE 3-continued

Significantly under-expressed gene activities in samples of patients with infectious MODS/MOF, if compared with the gene activities of patients with non-infectious MODS/MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| H18435 | 0.00 | 0.34 | −0.14 | 0.43 | 0.32 | 790 |
| R39782 | 0.00 | −0.35 | −0.82 | 0.44 | 0.35 | 791 |
| R38717 | 0.00 | −0.16 | −0.63 | 0.43 | 0.48 | 792 |
| H96798 | 0.00 | 0.19 | −0.27 | 0.47 | 0.53 | 793 |
| N72174 | 0.02 | 0.92 | 0.46 | 0.53 | 0.73 | 794 |
| AI739381 | 0.00 | −0.11 | −0.57 | 0.24 | 0.50 | 795 |
| AI654546 | 0.00 | 0.05 | −0.41 | 0.31 | 0.46 | 796 |
| AI097494 | 0.00 | −0.72 | −1.19 | 0.41 | 0.57 | 797 |
| NM_000612.2 | 0.00 | 0.93 | 0.47 | 0.50 | 0.36 | 798 |
| AI651536 | 0.00 | 0.62 | 0.16 | 0.50 | 0.29 | 799 |
| AI804425 | 0.00 | 0.90 | 0.44 | 0.73 | 0.38 | 800 |
| n67686 | 0.00 | 0.43 | −0.03 | 0.62 | 0.38 | 801 |
| NM_000062 | 0.01 | −0.18 | −0.63 | 0.75 | 0.45 | 802 |
| R54442 | 0.00 | 0.69 | 0.24 | 0.53 | 0.39 | 803 |
| AI475085 | 0.00 | 0.25 | −0.20 | 0.67 | 0.29 | 804 |
| AI700612 | 0.01 | −0.85 | −1.30 | 0.60 | 0.61 | 805 |
| AA447615 | 0.00 | 0.18 | −0.27 | 0.60 | 0.30 | 806 |
| AI223092 | 0.00 | −0.38 | −0.82 | 0.30 | 0.56 | 807 |
| AI262894 | 0.00 | 0.47 | 0.03 | 0.61 | 0.39 | 808 |
| R52949 | 0.01 | −1.08 | −1.52 | 0.44 | 0.72 | 809 |
| AA629034 | 0.00 | −0.13 | −0.57 | 0.37 | 0.33 | 810 |
| R12559 | 0.00 | 0.72 | 0.29 | 0.45 | 0.37 | 811 |
| AA910310 | 0.00 | 0.03 | −0.40 | 0.35 | 0.27 | 812 |
| NM_006850 | 0.01 | 0.19 | −0.24 | 0.59 | 0.51 | 813 |
| AI689080 | 0.05 | 1.34 | 0.91 | 0.74 | 0.78 | 814 |
| R23755 | 0.00 | 0.16 | −0.26 | 0.40 | 0.37 | 815 |
| N95041 | 0.00 | 0.17 | −0.25 | 0.30 | 0.40 | 816 |
| AA443712 | 0.01 | 0.76 | 0.34 | 0.72 | 0.41 | 817 |
| NM_033302 | 0.03 | 1.53 | 1.11 | 0.54 | 0.72 | 818 |
| AI700810 | 0.00 | 0.59 | 0.18 | 0.72 | 0.25 | 819 |
| XM_004011 | 0.00 | 0.52 | 0.11 | 0.44 | 0.35 | 820 |
| H11433 | 0.00 | 0.38 | −0.03 | 0.55 | 0.35 | 821 |
| NM_006890 | 0.03 | 1.14 | 0.73 | 0.77 | 0.52 | 822 |
| NM_138556 | 0.00 | 0.16 | −0.25 | 0.23 | 0.36 | 823 |
| XM_003937 | 0.00 | 0.13 | −0.28 | 0.34 | 0.33 | 824 |
| NM_000908.1 | 0.00 | −0.05 | −0.46 | 0.22 | 0.30 | 825 |
| NM_017567 | 0.01 | −0.52 | −0.92 | 0.57 | 0.47 | 826 |
| R89802 | 0.00 | −0.21 | −0.61 | 0.27 | 0.33 | 827 |
| NM_000715 | 0.01 | 0.77 | 0.37 | 0.56 | 0.46 | 828 |
| AI924733 | 0.00 | −0.60 | −1.00 | 0.37 | 0.50 | 829 |
| AI859370 | 0.00 | 0.17 | −0.23 | 0.16 | 0.24 | 830 |
| AI023558 | 0.00 | −0.41 | −0.80 | 0.23 | 0.37 | 831 |
| AA021303 | 0.00 | 0.19 | −0.20 | 0.58 | 0.25 | 832 |
| R69609 | 0.01 | 1.03 | 0.64 | 0.54 | 0.51 | 833 |
| XM_057445 | 0.00 | 0.27 | −0.12 | 0.35 | 0.39 | 834 |
| AA046302 | 0.00 | −0.10 | −0.49 | 0.36 | 0.33 | 835 |
| AI383451 | 0.01 | 0.26 | −0.13 | 0.53 | 0.40 | 836 |
| AA464191 | 0.00 | −0.46 | −0.84 | 0.32 | 0.41 | 837 |
| AA425808 | 0.00 | −0.22 | −0.61 | 0.25 | 0.51 | 838 |
| XM_038024 | 0.00 | 0.18 | −0.21 | 0.28 | 0.47 | 839 |
| AI016127 | 0.01 | 1.07 | 0.69 | 0.56 | 0.42 | 840 |
| AA400144 | 0.03 | −0.41 | −0.79 | 0.60 | 0.62 | 841 |
| R43074 | 0.00 | −0.99 | −1.36 | 0.28 | 0.51 | 842 |
| AI628936 | 0.01 | −0.65 | −1.03 | 0.41 | 0.51 | 843 |
| AA461499 | 0.00 | −0.16 | −0.54 | 0.39 | 0.38 | 844 |
| AI668673 | 0.00 | 0.34 | −0.03 | 0.35 | 0.50 | 845 |
| AI539443 | 0.00 | 0.24 | −0.13 | 0.39 | 0.43 | 846 |
| AA404231 | 0.04 | −0.14 | −0.52 | 0.52 | 0.69 | 847 |
| AI692869 | 0.01 | 0.72 | 0.34 | 0.30 | 0.53 | 848 |
| AI822099 | 0.00 | 0.00 | −0.37 | 0.51 | 0.34 | 849 |
| R20616 | 0.00 | 0.12 | −0.25 | 0.30 | 0.32 | 850 |
| AA453406 | 0.01 | −0.66 | −1.03 | 0.42 | 0.49 | 851 |
| AA282404 | 0.02 | 0.07 | −0.29 | 0.46 | 0.58 | 852 |
| AI023336 | 0.00 | 0.24 | −0.13 | 0.28 | 0.27 | 853 |
| NM_001964 | 0.02 | −0.63 | −0.99 | 0.56 | 0.53 | 854 |
| N35603 | 0.04 | −0.51 | −0.87 | 0.51 | 0.67 | 855 |
| AI632210 | 0.00 | 0.35 | −0.01 | 0.60 | 0.26 | 856 |
| AA156454 | 0.00 | 0.37 | 0.01 | 0.34 | 0.35 | 857 |

TABLE 3-continued

Significantly under-expressed gene activities in samples of patients with infectious MODS/MOF, if compared with the gene activities of patients with non-infectious MODS/MOF.

| | | Mean normalised and transformed expression value | | Standard deviation | | |
| --- | --- | --- | --- | --- | --- | --- |
| GenBank Accession No. | p-value | Group of patients with non-infectious MOF | Group of patients with infectious MOF | Group of patients with non-infectious MOF | Group of patients with infectious MOF | SEQUENCE-ID |
| AA620836 | 0.02 | 0.24 | −0.12 | 0.51 | 0.55 | 858 |
| NM_020530 | 0.00 | 0.37 | 0.01 | 0.44 | 0.30 | 859 |
| AA928277 | 0.00 | −0.10 | −0.46 | 0.34 | 0.36 | 860 |
| NM_001559 | 0.04 | 0.37 | 0.01 | 0.73 | 0.50 | 861 |
| AA401691 | 0.00 | −0.08 | −0.44 | 0.39 | 0.38 | 862 |
| NM_015991 | 0.00 | 0.01 | −0.34 | 0.46 | 0.33 | 863 |
| N80764 | 0.00 | −0.08 | −0.43 | 0.33 | 0.43 | 864 |
| L34657 | 0.00 | 0.12 | −0.23 | 0.31 | 0.34 | 865 |
| H98244 | 0.00 | 0.24 | −0.11 | 0.39 | 0.35 | 866 |
| AA894523 | 0.00 | −0.24 | −0.59 | 0.23 | 0.29 | 867 |
| NM_013261.1 | 0.00 | 0.08 | −0.26 | 0.32 | 0.37 | 868 |
| H02254 | 0.01 | −0.39 | −0.73 | 0.40 | 0.45 | 869 |
| NM_003781.2 | 0.01 | −0.64 | −0.98 | 0.50 | 0.36 | 870 |
| NM_001243 | 0.05 | 0.78 | 0.44 | 0.51 | 0.66 | 871 |
| AA442897 | 0.01 | −0.44 | −0.78 | 0.32 | 0.46 | 872 |
| T85314 | 0.01 | −0.29 | −0.63 | 0.46 | 0.43 | 873 |
| AI658519 | 0.05 | 0.50 | 0.16 | 0.70 | 0.50 | 874 |
| AI207975 | 0.00 | −0.28 | −0.62 | 0.37 | 0.30 | 875 |
| AI536602 | 0.00 | 0.28 | −0.06 | 0.47 | 0.33 | 876 |
| NM_001541.1 | 0.00 | 0.50 | 0.16 | 0.38 | 0.27 | 877 |
| AA992540 | 0.00 | 0.14 | −0.19 | 0.31 | 0.32 | 878 |
| Z22971 | 0.01 | 0.62 | 0.29 | 0.51 | 0.39 | 879 |
| AI560847 | 0.00 | 0.36 | 0.03 | 0.23 | 0.28 | 880 |
| XM_008346 | 0.04 | 0.40 | 0.07 | 0.59 | 0.54 | 881 |
| AA015795 | 0.02 | −0.36 | −0.69 | 0.57 | 0.42 | 882 |
| R00742 | 0.00 | 0.37 | 0.04 | 0.34 | 0.33 | 883 |
| H16774 | 0.00 | 0.02 | −0.31 | 0.33 | 0.24 | 884 |
| R51373 | 0.00 | 0.15 | −0.18 | 0.31 | 0.24 | 885 |
| AI479659 | 0.00 | 0.18 | −0.14 | 0.34 | 0.29 | 886 |
| W58195 | 0.00 | −0.06 | −0.39 | 0.27 | 0.39 | 887 |
| NM_004437.1 | 0.05 | 1.06 | 0.73 | 0.47 | 0.65 | 888 |
| AA479357 | 0.00 | 0.18 | −0.15 | 0.30 | 0.21 | 889 |
| AI423518 | 0.00 | −0.25 | −0.57 | 0.29 | 0.40 | 890 |
| NM_002750 | 0.01 | −0.52 | −0.85 | 0.36 | 0.44 | 891 |
| R26444 | 0.00 | 0.00 | −0.32 | 0.27 | 0.36 | 892 |
| AA136071 | 0.00 | 0.04 | −0.29 | 0.25 | 0.34 | 893 |
| AI554459 | 0.00 | −0.02 | −0.34 | 0.39 | 0.35 | 894 |
| N51537 | 0.02 | 0.89 | 0.57 | 0.45 | 0.49 | 895 |
| NM_006068 | 0.00 | 0.62 | 0.30 | 0.35 | 0.39 | 896 |
| NM_016184 | 0.03 | 0.61 | 0.29 | 0.49 | 0.52 | 897 |
| NM_000586 | 0.03 | 0.03 | −0.29 | 0.40 | 0.54 | 898 |
| NM_003102.1 | 0.01 | −0.39 | −0.71 | 0.49 | 0.43 | 899 |
| AI264774 | 0.00 | −0.11 | −0.43 | 0.20 | 0.44 | 900 |
| N90536 | 0.01 | −0.45 | −0.77 | 0.30 | 0.45 | 901 |
| AA404342 | 0.00 | −0.29 | −0.61 | 0.36 | 0.36 | 902 |
| AI373525 | 0.00 | −0.16 | −0.48 | 0.30 | 0.25 | 903 |
| AI579907 | 0.00 | 0.07 | −0.25 | 0.38 | 0.25 | 904 |
| AA279410 | 0.00 | 0.11 | −0.21 | 0.33 | 0.26 | 905 |
| XM_038308 | 0.04 | 0.35 | 0.03 | 0.51 | 0.54 | 906 |
| NM_000879 | 0.02 | −0.01 | −0.33 | 0.37 | 0.52 | 907 |
| NM_001078) | 0.00 | 0.38 | 0.07 | 0.38 | 0.32 | 908 |
| AA781411 | 0.00 | −0.24 | −0.55 | 0.23 | 0.37 | 909 |
| R07171 | 0.00 | −0.16 | −0.48 | 0.34 | 0.37 | 910 |
| AA136273 | 0.00 | −0.10 | −0.41 | 0.26 | 0.32 | 911 |
| AI565469 | 0.01 | −0.06 | −0.37 | 0.32 | 0.41 | 912 |
| AI799767 | 0.00 | −0.12 | −0.44 | 0.35 | 0.36 | 913 |
| AI889554 | 0.00 | −0.08 | −0.39 | 0.34 | 0.36 | 914 |
| AA410301 | 0.01 | 0.77 | 0.46 | 0.35 | 0.42 | 915 |
| AA995114 | 0.04 | 1.09 | 0.79 | 0.67 | 0.40 | 916 |
| AI694444 | 0.00 | −0.40 | −0.71 | 0.26 | 0.35 | 917 |
| T98940 | 0.00 | 0.05 | −0.26 | 0.45 | 0.27 | 918 |
| R16722 | 0.00 | 0.07 | −0.23 | 0.42 | 0.23 | 919 |
| H05436 | 0.00 | 0.40 | 0.10 | 0.34 | 0.33 | 920 |
| R42778 | 0.01 | 0.39 | 0.09 | 0.45 | 0.33 | 921 |
| AI378275 | 0.00 | −0.02 | −0.33 | 0.29 | 0.40 | 922 |
| XM_083833 | 0.03 | 0.50 | 0.20 | 0.57 | 0.39 | 923 |
| R94894 | 0.03 | 1.00 | 0.70 | 0.35 | 0.55 | 924 |
| H15677 | 0.01 | −0.24 | −0.54 | 0.34 | 0.45 | 925 |

TABLE 3-continued

Significantly under-expressed gene activities in samples of patients with infectious MODS/MOF, if compared with the gene activities of patients with non-infectious MODS/MOF.

| GenBank Accession No. | p-value | Mean normalised and transformed expression value | | Standard deviation | | SEQUENCE-ID |
| --- | --- | --- | --- | --- | --- | --- |
| | | Group of patients with non-infectious MOF | Group of patients with infectious MOF | Group of patients with non-infectious MOF | Group of patients with infectious MOF | |
| AI625523 | 0.04 | 0.75 | 0.45 | 0.47 | 0.51 | 926 |
| AI627286 | 0.00 | 0.03 | −0.27 | 0.35 | 0.26 | 927 |
| NM_003807 | 0.01 | 0.08 | −0.22 | 0.35 | 0.42 | 928 |
| NM_002757 | 0.02 | 0.00 | −0.30 | 0.50 | 0.41 | 929 |
| XM_008411 | 0.02 | −0.47 | −0.77 | 0.31 | 0.51 | 930 |
| AI379294 | 0.01 | −0.06 | −0.35 | 0.45 | 0.32 | 931 |
| AI824470 | 0.00 | −0.20 | −0.49 | 0.19 | 0.42 | 932 |
| N94525 | 0.00 | 0.15 | −0.14 | 0.26 | 0.28 | 933 |
| R38432 | 0.01 | −0.03 | −0.32 | 0.27 | 0.41 | 934 |
| NM_017436.2 | 0.02 | −0.44 | −0.74 | 0.42 | 0.44 | 935 |
| AA398968 | 0.00 | −0.03 | −0.33 | 0.37 | 0.35 | 936 |
| U15085 | 0.03 | −0.89 | −1.18 | 0.47 | 0.47 | 937 |
| AI734941 | 0.01 | −0.14 | −0.43 | 0.31 | 0.41 | 938 |
| AI819159 | 0.00 | 0.44 | 0.15 | 0.39 | 0.28 | 939 |
| AA426024 | 0.02 | −0.11 | −0.40 | 0.46 | 0.42 | 940 |
| AA435854 | 0.00 | −0.33 | −0.62 | 0.21 | 0.28 | 941 |
| NM_003264 | 0.00 | 0.28 | −0.01 | 0.30 | 0.38 | 942 |
| NM_001622.1 | 0.04 | 0.01 | −0.28 | 0.41 | 0.53 | 943 |
| AI828714 | 0.04 | −0.25 | −0.55 | 0.33 | 0.54 | 944 |
| NM_006610 | 0.00 | −0.04 | −0.33 | 0.23 | 0.30 | 945 |
| AI143013 | 0.00 | −0.04 | −0.33 | 0.38 | 0.31 | 946 |
| AA428992 | 0.01 | 0.50 | 0.21 | 0.48 | 0.24 | 947 |
| R40560 | 0.02 | 0.17 | −0.12 | 0.33 | 0.44 | 948 |
| AI203091 | 0.02 | −0.44 | −0.73 | 0.28 | 0.50 | 949 |
| T92041 | 0.00 | 0.07 | −0.22 | 0.28 | 0.22 | 950 |
| AA453794 | 0.00 | 0.20 | −0.09 | 0.22 | 0.29 | 951 |
| R05804 | 0.00 | 0.18 | −0.11 | 0.22 | 0.34 | 952 |
| AA453489 | 0.01 | −0.56 | −0.85 | 0.33 | 0.37 | 953 |
| NM_006664 | 0.00 | 0.67 | 0.39 | 0.30 | 0.35 | 954 |
| AA281330 | 0.03 | 0.76 | 0.48 | 0.57 | 0.38 | 955 |
| AA452139 | 0.00 | 0.08 | −0.20 | 0.31 | 0.24 | 956 |
| R43204 | 0.00 | 0.19 | −0.09 | 0.38 | 0.21 | 957 |
| NM_012340 | 0.01 | 0.05 | −0.24 | 0.36 | 0.40 | 958 |
| NM_004778 | 0.02 | 0.00 | −0.28 | 0.43 | 0.40 | 959 |
| AA490815 | 0.01 | 0.04 | −0.24 | 0.26 | 0.44 | 960 |
| NM_022740 | 0.00 | 0.47 | 0.19 | 0.30 | 0.31 | 961 |
| AI167874 | 0.01 | 0.33 | 0.05 | 0.41 | 0.33 | 962 |
| AA149968 | 0.00 | −0.09 | −0.37 | 0.28 | 0.27 | 963 |
| XM_058179 | 0.03 | −0.04 | −0.32 | 0.58 | 0.35 | 964 |
| R07502 | 0.00 | −0.42 | −0.70 | 0.33 | 0.31 | 965 |
| NM_000752 | 0.01 | −0.27 | −0.56 | 0.48 | 0.29 | 966 |
| XM_003529 | 0.01 | 0.22 | −0.06 | 0.42 | 0.38 | 967 |
| N64541 | 0.01 | 0.13 | −0.15 | 0.44 | 0.37 | 968 |
| NM_001054 | 0.01 | 0.18 | −0.10 | 0.32 | 0.40 | 969 |
| AI499407 | 0.00 | 0.00 | −0.28 | 0.30 | 0.27 | 970 |
| NM_020056 | 0.00 | −0.05 | −0.33 | 0.32 | 0.28 | 971 |
| AA004952 | 0.01 | −0.20 | −0.48 | 0.41 | 0.31 | 972 |
| AI624610 | 0.01 | 0.09 | −0.19 | 0.34 | 0.38 | 973 |
| AA421924 | 0.04 | 0.92 | 0.64 | 0.49 | 0.44 | 974 |
| AI732550 | 0.04 | 0.03 | −0.25 | 0.51 | 0.43 | 975 |
| AI374599 | 0.02 | −0.15 | −0.43 | 0.24 | 0.47 | 976 |
| AI582909 | 0.00 | 0.34 | 0.06 | 0.21 | 0.21 | 977 |
| AI554111 | 0.00 | 0.21 | −0.07 | 0.39 | 0.21 | 978 |
| NM_001734 | 0.00 | −0.21 | −0.49 | 0.21 | 0.37 | 979 |
| AA810014 | 0.03 | 0.23 | −0.05 | 0.56 | 0.33 | 980 |
| AI373295 | 0.00 | 0.32 | 0.05 | 0.31 | 0.23 | 981 |
| XM_048555 | 0.01 | −0.20 | −0.48 | 0.38 | 0.34 | 982 |
| AA435627 | 0.00 | 0.15 | −0.13 | 0.31 | 0.26 | 983 |
| T95815 | 0.00 | 0.55 | 0.27 | 0.33 | 0.32 | 984 |
| AA426030 | 0.03 | −0.14 | −0.42 | 0.40 | 0.42 | 985 |
| AI720051 | 0.01 | −0.29 | −0.56 | 0.30 | 0.43 | 986 |
| AI278521 | 0.01 | −0.50 | −0.77 | 0.39 | 0.34 | 987 |
| N93236 | 0.01 | 0.38 | 0.10 | 0.38 | 0.34 | 988 |
| NM_015645 | 0.03 | −0.28 | −0.55 | 0.44 | 0.43 | 989 |
| AI671360 | 0.00 | 0.22 | −0.05 | 0.28 | 0.28 | 990 |
| T83666 | 0.00 | 0.13 | −0.14 | 0.36 | 0.21 | 991 |
| W02063 | 0.00 | −0.02 | −0.30 | 0.31 | 0.31 | 992 |
| AI659563 | 0.00 | 0.01 | −0.26 | 0.27 | 0.21 | 993 |

TABLE 3-continued

Significantly under-expressed gene activities in samples of patients with infectious MODS/MOF, if compared with the gene activities of patients with non-infectious MODS/MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| NM_139046 | 0.02 | −0.47 | −0.74 | 0.35 | 0.45 | 994 |
| AA155745 | 0.00 | 0.00 | −0.27 | 0.31 | 0.26 | 995 |
| H40035 | 0.01 | −0.32 | −0.59 | 0.28 | 0.38 | 996 |
| AA101379 | 0.00 | 0.26 | −0.02 | 0.35 | 0.31 | 997 |
| H16790 | 0.00 | 0.22 | −0.05 | 0.37 | 0.28 | 998 |
| AA011511 | 0.02 | −0.29 | −0.55 | 0.32 | 0.41 | 999 |
| AA746495 | 0.05 | 0.17 | −0.10 | 0.56 | 0.39 | 1000 |
| AA845015 | 0.00 | −0.04 | −0.30 | 0.34 | 0.26 | 1001 |
| NM_138636 | 0.05 | 0.51 | 0.24 | 0.39 | 0.52 | 1002 |
| NM_033358 | 0.01 | 0.50 | 0.24 | 0.37 | 0.37 | 1003 |
| AI650349 | 0.02 | −0.13 | −0.39 | 0.40 | 0.41 | 1004 |
| NM_001764 | 0.01 | 0.33 | 0.06 | 0.46 | 0.20 | 1005 |
| XM_006447 | 0.03 | −0.53 | −0.80 | 0.49 | 0.39 | 1006 |
| R07185 | 0.00 | 0.12 | −0.14 | 0.34 | 0.22 | 1007 |
| AA187437 | 0.00 | −0.01 | −0.27 | 0.21 | 0.26 | 1008 |
| AI621365 | 0.00 | 0.25 | −0.02 | 0.34 | 0.28 | 1009 |
| NM_020205 | 0.03 | 0.16 | −0.10 | 0.29 | 0.48 | 1010 |
| AI888390 | 0.01 | −0.89 | −1.15 | 0.31 | 0.40 | 1011 |
| AI674699 | 0.01 | −0.09 | −0.35 | 0.34 | 0.37 | 1012 |
| AI620249 | 0.02 | 0.02 | −0.24 | 0.49 | 0.27 | 1013 |
| NM_033295 | 0.02 | −0.32 | −0.58 | 0.41 | 0.39 | 1014 |
| NM_015718.1 | 0.00 | −0.08 | −0.34 | 0.23 | 0.34 | 1015 |
| N73572 | 0.05 | 0.05 | −0.21 | 0.45 | 0.42 | 1016 |
| AI420037 | 0.02 | 0.04 | −0.22 | 0.46 | 0.31 | 1017 |
| AI684431 | 0.00 | 0.28 | 0.03 | 0.32 | 0.27 | 1018 |
| AA017263 | 0.00 | 0.11 | −0.14 | 0.38 | 0.25 | 1019 |
| R45118 | 0.01 | 0.16 | −0.10 | 0.32 | 0.33 | 1020 |
| AI267659 | 0.04 | 0.01 | −0.25 | 0.21 | 0.53 | 1021 |
| AA406083 | 0.03 | 0.00 | −0.26 | 0.38 | 0.41 | 1022 |
| W48664 | 0.00 | 0.21 | −0.05 | 0.31 | 0.22 | 1023 |
| AA514450 | 0.00 | −0.38 | −0.63 | 0.26 | 0.33 | 1024 |
| AI150305 | 0.00 | 0.30 | 0.04 | 0.23 | 0.32 | 1025 |
| AA481504 | 0.03 | −0.74 | −0.99 | 0.37 | 0.42 | 1026 |
| R44840 | 0.02 | 0.22 | −0.04 | 0.45 | 0.32 | 1027 |
| AI160757 | 0.00 | 0.21 | −0.05 | 0.29 | 0.29 | 1028 |
| AA040870 | 0.00 | 0.24 | −0.02 | 0.30 | 0.30 | 1029 |
| AI342905 | 0.02 | 0.49 | 0.24 | 0.43 | 0.35 | 1030 |
| N68463 | 0.05 | 0.09 | −0.16 | 0.46 | 0.43 | 1031 |
| AA398760 | 0.00 | 0.05 | −0.20 | 0.24 | 0.23 | 1032 |
| AI798514 | 0.00 | 0.26 | 0.00 | 0.30 | 0.25 | 1033 |
| AI081725 | 0.00 | 0.18 | −0.07 | 0.31 | 0.28 | 1034 |
| AI799385 | 0.03 | 0.44 | 0.19 | 0.45 | 0.37 | 1035 |
| AA897543 | 0.04 | −0.24 | −0.49 | 0.28 | 0.49 | 1036 |
| N79807 | 0.01 | 0.18 | −0.07 | 0.33 | 0.33 | 1037 |
| AI676097 | 0.05 | 0.21 | −0.04 | 0.57 | 0.32 | 1038 |
| R46372 | 0.01 | 0.02 | −0.23 | 0.28 | 0.37 | 1039 |
| AA448817 | 0.00 | 0.26 | 0.01 | 0.28 | 0.27 | 1040 |
| AI810161 | 0.01 | 0.09 | −0.16 | 0.31 | 0.38 | 1041 |
| H80437 | 0.00 | 0.18 | −0.07 | 0.23 | 0.29 | 1042 |
| AA443664 | 0.00 | −0.02 | −0.27 | 0.29 | 0.27 | 1043 |
| NM_002957.3 | 0.01 | −0.12 | −0.37 | 0.24 | 0.37 | 1044 |
| N69363 | 0.03 | −0.35 | −0.59 | 0.37 | 0.40 | 1045 |
| NM_000552.2 | 0.01 | −0.11 | −0.36 | 0.25 | 0.34 | 1046 |
| AA455080 | 0.01 | 0.08 | −0.16 | 0.34 | 0.28 | 1047 |
| W32272 | 0.00 | −0.25 | −0.50 | 0.26 | 0.30 | 1048 |
| H38087 | 0.04 | 0.76 | 0.51 | 0.34 | 0.47 | 1049 |
| AA504336 | 0.01 | 0.26 | 0.02 | 0.32 | 0.33 | 1050 |
| H04977 | 0.00 | 0.45 | 0.21 | 0.28 | 0.28 | 1051 |
| NM_002670 | 0.05 | 0.19 | −0.06 | 0.32 | 0.50 | 1052 |
| R09417 | 0.02 | −0.07 | −0.32 | 0.31 | 0.41 | 1053 |
| AA040057 | 0.02 | −0.05 | −0.29 | 0.35 | 0.37 | 1054 |
| AI263210 | 0.01 | −0.10 | −0.34 | 0.27 | 0.33 | 1055 |
| AI264626 | 0.01 | −0.12 | −0.37 | 0.33 | 0.29 | 1056 |
| AI478847 | 0.02 | 0.11 | −0.13 | 0.34 | 0.40 | 1057 |
| AI744042 | 0.03 | −0.37 | −0.61 | 0.51 | 0.27 | 1058 |
| AA682790 | 0.02 | 0.01 | −0.23 | 0.32 | 0.40 | 1059 |
| AA629051 | 0.01 | 0.28 | 0.04 | 0.32 | 0.29 | 1060 |
| AI560242 | 0.02 | −0.23 | −0.47 | 0.36 | 0.34 | 1061 |

TABLE 3-continued

Significantly under-expressed gene activities in samples of patients with infectious MODS/MOF, if compared with the gene activities of patients with non-infectious MODS/MOF.

| GenBank Accession No. | p-value | Mean normalised and transformed expression value | | Standard deviation | | SEQUENCE-ID |
| --- | --- | --- | --- | --- | --- | --- |
| | | Group of patients with non-infectious MOF | Group of patients with infectious MOF | Group of patients with non-infectious MOF | Group of patients with infectious MOF | |
| AA035428 | 0.01 | −0.14 | −0.38 | 0.26 | 0.32 | 1062 |
| NM_014326 | 0.02 | 0.11 | −0.13 | 0.52 | 0.15 | 1063 |
| AI632740 | 0.01 | −0.16 | −0.40 | 0.31 | 0.30 | 1064 |
| AI130878 | 0.01 | 0.27 | 0.03 | 0.32 | 0.31 | 1065 |
| AI933013 | 0.01 | 0.31 | 0.07 | 0.35 | 0.26 | 1066 |
| AI086719 | 0.01 | 0.00 | −0.24 | 0.37 | 0.24 | 1067 |
| R16568 | 0.03 | 0.10 | −0.14 | 0.24 | 0.46 | 1068 |
| AA009562 | 0.01 | −0.20 | −0.44 | 0.28 | 0.33 | 1069 |
| AI015069 | 0.01 | 0.04 | −0.20 | 0.32 | 0.34 | 1070 |
| AA291486 | 0.02 | −0.26 | −0.49 | 0.31 | 0.36 | 1071 |
| H65288 | 0.03 | −0.13 | −0.37 | 0.26 | 0.46 | 1072 |
| W86767 | 0.02 | 0.07 | −0.17 | 0.20 | 0.42 | 1073 |
| H65331 | 0.01 | 0.55 | 0.31 | 0.33 | 0.33 | 1074 |
| AA478985 | 0.04 | −0.12 | −0.36 | 0.20 | 0.51 | 1075 |
| H11274 | 0.02 | −0.02 | −0.26 | 0.28 | 0.40 | 1076 |
| AA044225 | 0.00 | −0.09 | −0.33 | 0.31 | 0.22 | 1077 |
| AI801415 | 0.00 | −0.08 | −0.32 | 0.32 | 0.23 | 1078 |
| AA846527 | 0.00 | −0.14 | −0.37 | 0.24 | 0.25 | 1079 |
| R56890 | 0.01 | −0.04 | −0.28 | 0.25 | 0.34 | 1080 |
| AI921525 | 0.03 | −0.06 | −0.29 | 0.36 | 0.40 | 1081 |
| AA405485 | 0.02 | 0.11 | −0.13 | 0.40 | 0.33 | 1082 |
| AA845635 | 0.00 | −0.03 | −0.26 | 0.31 | 0.26 | 1083 |
| AI150418 | 0.01 | 0.07 | −0.17 | 0.23 | 0.33 | 1084 |
| XM_049849 | 0.02 | 0.55 | 0.32 | 0.32 | 0.37 | 1085 |
| AA406573 | 0.00 | 0.20 | −0.03 | 0.33 | 0.23 | 1086 |
| AA043930 | 0.01 | −0.26 | −0.49 | 0.27 | 0.35 | 1087 |
| AI125496 | 0.01 | −0.30 | −0.53 | 0.29 | 0.33 | 1088 |
| AI654739 | 0.02 | −0.06 | −0.29 | 0.31 | 0.35 | 1089 |
| AA398320 | 0.01 | −0.32 | −0.56 | 0.37 | 0.30 | 1090 |
| NM_002155 | 0.04 | 0.48 | 0.25 | 0.36 | 0.43 | 1091 |
| AA505872 | 0.01 | 0.71 | 0.48 | 0.31 | 0.34 | 1092 |
| NM_016610 | 0.02 | 0.24 | 0.00 | 0.20 | 0.43 | 1093 |
| AA703200 | 0.00 | −0.13 | −0.36 | 0.26 | 0.29 | 1094 |
| R44493 | 0.00 | 0.04 | −0.19 | 0.24 | 0.23 | 1095 |
| XM_046575 | 0.04 | −0.14 | −0.38 | 0.40 | 0.40 | 1096 |
| AI275613 | 0.03 | 0.24 | 0.00 | 0.44 | 0.30 | 1097 |
| AI308602 | 0.04 | 0.19 | −0.05 | 0.38 | 0.40 | 1098 |
| R44328 | 0.01 | 0.24 | 0.01 | 0.30 | 0.30 | 1099 |
| R00206 | 0.00 | 0.07 | −0.16 | 0.23 | 0.31 | 1100 |
| NM_002456 | 0.01 | 0.02 | −0.21 | 0.37 | 0.25 | 1101 |
| AI699371 | 0.03 | −0.18 | −0.41 | 0.46 | 0.28 | 1102 |
| AA935135 | 0.03 | 0.21 | −0.02 | 0.41 | 0.33 | 1103 |
| AA702529 | 0.02 | 0.06 | −0.17 | 0.40 | 0.27 | 1104 |
| AI568023 | 0.02 | −0.19 | −0.42 | 0.36 | 0.30 | 1105 |
| NM_002768 | 0.01 | −0.65 | −0.88 | 0.27 | 0.31 | 1106 |
| AA687208 | 0.02 | −0.32 | −0.55 | 0.24 | 0.39 | 1107 |
| AI221524 | 0.04 | 0.47 | 0.25 | 0.49 | 0.31 | 1108 |
| AA813007 | 0.01 | 0.09 | −0.13 | 0.24 | 0.33 | 1109 |
| AA421326 | 0.02 | −0.33 | −0.55 | 0.28 | 0.38 | 1110 |
| AA922397 | 0.01 | 0.06 | −0.17 | 0.19 | 0.33 | 1111 |
| R51857 | 0.03 | 0.90 | 0.67 | 0.40 | 0.30 | 1112 |
| NM_006564 | 0.00 | −0.22 | −0.44 | 0.33 | 0.21 | 1113 |
| AA807376 | 0.01 | 0.39 | 0.17 | 0.31 | 0.25 | 1114 |
| AA812763 | 0.04 | −0.45 | −0.68 | 0.36 | 0.37 | 1115 |
| AA528169 | 0.02 | 0.34 | 0.12 | 0.37 | 0.32 | 1116 |
| AI804325 | 0.01 | −0.14 | −0.36 | 0.32 | 0.24 | 1117 |
| T70330 | 0.04 | −0.10 | −0.33 | 0.30 | 0.41 | 1118 |
| NM_001766 | 0.03 | 0.30 | 0.08 | 0.39 | 0.35 | 1119 |
| AI696956 | 0.01 | −0.12 | −0.34 | 0.40 | 0.23 | 1120 |
| AI459174 | 0.01 | −0.05 | −0.27 | 0.30 | 0.25 | 1121 |
| R35639 | 0.01 | −0.03 | −0.25 | 0.17 | 0.37 | 1122 |
| W69774 | 0.01 | −0.02 | −0.24 | 0.21 | 0.30 | 1123 |
| AA054265 | 0.05 | 0.37 | 0.15 | 0.40 | 0.38 | 1124 |
| AI382995 | 0.01 | 0.19 | −0.03 | 0.29 | 0.25 | 1125 |
| AI218303 | 0.01 | 0.00 | −0.22 | 0.31 | 0.26 | 1126 |
| AI624954 | 0.01 | −0.18 | −0.40 | 0.28 | 0.31 | 1127 |
| AA759254 | 0.05 | −0.08 | −0.30 | 0.49 | 0.29 | 1128 |
| AI682979 | 0.02 | 0.03 | −0.19 | 0.22 | 0.37 | 1129 |

TABLE 3-continued

Significantly under-expressed gene activities in samples of patients with infectious MODS/MOF, if compared with the gene activities of patients with non-infectious MODS/MOF.

| GenBank Accession No. | p-value | Mean normalised and transformed expression value | | Standard deviation | | SEQUENCE-ID |
|---|---|---|---|---|---|---|
| | | Group of patients with non-infectious MOF | Group of patients with infectious MOF | Group of patients with non-infectious MOF | Group of patients with infectious MOF | |
| XM_001754 | 0.01 | 0.18 | −0.03 | 0.31 | 0.28 | 1130 |
| AI187401 | 0.00 | −0.01 | −0.23 | 0.21 | 0.22 | 1131 |
| AA452113 | 0.01 | 0.24 | 0.02 | 0.25 | 0.30 | 1132 |
| AI656210 | 0.04 | −0.48 | −0.70 | 0.30 | 0.40 | 1133 |
| N29999 | 0.01 | 0.21 | 0.00 | 0.22 | 0.34 | 1134 |
| N68557 | 0.01 | 0.00 | −0.21 | 0.19 | 0.32 | 1135 |
| AI689672 | 0.02 | −0.08 | −0.29 | 0.42 | 0.19 | 1136 |
| AA730310 | 0.00 | −0.07 | −0.28 | 0.25 | 0.22 | 1137 |
| AI431324 | 0.01 | −0.20 | −0.42 | 0.39 | 0.22 | 1138 |
| NM_000066 | 0.04 | −0.11 | −0.32 | 0.31 | 0.40 | 1139 |
| XM_034219 | 0.01 | 0.01 | −0.21 | 0.30 | 0.29 | 1140 |
| R43258 | 0.04 | 0.27 | 0.05 | 0.49 | 0.23 | 1141 |
| AI431293 | 0.00 | 0.07 | −0.15 | 0.25 | 0.22 | 1142 |
| R80259 | 0.04 | −0.49 | −0.70 | 0.22 | 0.38 | 1143 |
| AI126520 | 0.00 | 0.13 | −0.08 | 0.22 | 0.21 | 1144 |
| AA937226 | 0.00 | 0.02 | −0.19 | 0.25 | 0.26 | 1145 |
| AI191762 | 0.03 | −0.22 | −0.43 | 0.30 | 0.36 | 1146 |
| AA400470 | 0.00 | −0.10 | −0.31 | 0.34 | 0.17 | 1147 |
| NM_000063 | 0.01 | −0.17 | −0.38 | 0.29 | 0.23 | 1148 |
| H73962 | 0.01 | −0.11 | −0.32 | 0.22 | 0.30 | 1149 |
| AA626313 | 0.01 | −0.06 | −0.27 | 0.23 | 0.30 | 1150 |
| AI553630 | 0.03 | 0.13 | −0.08 | 0.36 | 0.31 | 1151 |
| NM_000257.1 | 0.01 | 0.37 | 0.16 | 0.29 | 0.25 | 1152 |
| N68456 | 0.03 | 0.33 | 0.12 | 0.27 | 0.36 | 1153 |
| XM_054837 | 0.01 | 0.24 | 0.04 | 0.24 | 0.27 | 1154 |
| AI696558 | 0.04 | −0.49 | −0.70 | 0.38 | 0.33 | 1155 |
| AI299876 | 0.05 | 0.03 | −0.18 | 0.36 | 0.37 | 1156 |
| NM_006378 | 0.03 | 0.65 | 0.44 | 0.28 | 0.36 | 1157 |
| AI376955 | 0.02 | −0.56 | −0.76 | 0.31 | 0.33 | 1158 |
| AA025573 | 0.01 | −0.24 | −0.45 | 0.33 | 0.25 | 1159 |
| T99196 | 0.02 | 0.14 | −0.07 | 0.34 | 0.29 | 1160 |
| XM_005637 | 0.05 | 0.25 | 0.05 | 0.19 | 0.45 | 1161 |
| AI597729 | 0.04 | −0.01 | −0.21 | 0.24 | 0.41 | 1162 |
| H78135 | 0.02 | 0.04 | −0.17 | 0.29 | 0.33 | 1163 |
| AI695029 | 0.01 | 0.04 | −0.16 | 0.27 | 0.25 | 1164 |
| AA004279 | 0.02 | −0.18 | −0.39 | 0.21 | 0.34 | 1165 |
| AA844020 | 0.03 | 0.33 | 0.12 | 0.30 | 0.33 | 1166 |
| AI332536 | 0.00 | −0.12 | −0.33 | 0.20 | 0.18 | 1167 |
| AI383368 | 0.03 | −0.40 | −0.61 | 0.21 | 0.38 | 1168 |
| AA423883 | 0.00 | −0.06 | −0.26 | 0.17 | 0.28 | 1169 |
| R36006 | 0.02 | −0.06 | −0.26 | 0.30 | 0.29 | 1170 |
| AI911837 | 0.02 | −0.05 | −0.26 | 0.30 | 0.31 | 1171 |
| AI696820 | 0.03 | −0.37 | −0.57 | 0.32 | 0.34 | 1172 |
| H30516 | 0.02 | −0.17 | −0.37 | 0.22 | 0.34 | 1173 |
| AI926561 | 0.01 | 0.02 | −0.18 | 0.37 | 0.20 | 1174 |
| H61449 | 0.02 | −0.25 | −0.45 | 0.24 | 0.32 | 1175 |
| AA410338 | 0.02 | −0.18 | −0.38 | 0.37 | 0.26 | 1176 |
| AA485229 | 0.00 | 0.05 | −0.15 | 0.18 | 0.18 | 1177 |
| AA044828 | 0.01 | −0.01 | −0.21 | 0.22 | 0.31 | 1178 |
| R07278 | 0.03 | 0.00 | −0.20 | 0.15 | 0.39 | 1179 |
| AI687656 | 0.02 | −0.22 | −0.42 | 0.28 | 0.28 | 1180 |
| AI912316 | 0.03 | 0.21 | 0.01 | 0.42 | 0.24 | 1181 |
| AA017301 | 0.00 | −0.07 | −0.27 | 0.18 | 0.26 | 1182 |
| AA059314 | 0.05 | 0.13 | −0.07 | 0.26 | 0.40 | 1183 |
| NM_024302.2 | 0.04 | 0.20 | 0.00 | 0.29 | 0.35 | 1184 |
| AA446463 | 0.02 | −0.15 | −0.34 | 0.29 | 0.29 | 1185 |
| NM_002747 | 0.01 | 0.19 | −0.01 | 0.24 | 0.24 | 1186 |
| AA446316 | 0.02 | 0.03 | −0.17 | 0.30 | 0.29 | 1187 |
| NM_052813) | 0.05 | −0.22 | −0.42 | 0.39 | 0.30 | 1188 |
| AA731532 | 0.00 | −0.24 | −0.43 | 0.18 | 0.24 | 1189 |
| R00307 | 0.04 | 0.16 | −0.03 | 0.45 | 0.20 | 1190 |
| AI924296 | 0.03 | −0.08 | −0.28 | 0.19 | 0.36 | 1191 |
| AI017741 | 0.01 | 0.07 | −0.12 | 0.29 | 0.21 | 1192 |
| AI619681 | 0.01 | −0.18 | −0.37 | 0.17 | 0.29 | 1193 |
| AA400967 | 0.01 | 0.25 | 0.06 | 0.30 | 0.22 | 1194 |
| NM_000680.1 | 0.01 | 0.28 | 0.09 | 0.20 | 0.28 | 1195 |
| AI732878 | 0.00 | −0.09 | −0.28 | 0.16 | 0.16 | 1196 |
| XM_006454 | 0.02 | −0.08 | −0.27 | 0.34 | 0.24 | 1197 |

TABLE 3-continued

Significantly under-expressed gene activities in samples of patients with infectious MODS/MOF, if compared with the gene activities of patients with non-infectious MODS/MOF.

| | | Mean normalised and transformed expression value | | Standard deviation | | |
| --- | --- | --- | --- | --- | --- | --- |
| GenBank Accession No. | p-value | Group of patients with non-infectious MOF | Group of patients with infectious MOF | Group of patients with non-infectious MOF | Group of patients with infectious MOF | SEQUENCE-ID |
| AI688916 | 0.03 | 0.02 | −0.17 | 0.32 | 0.29 | 1198 |
| T79834 | 0.01 | 0.09 | −0.10 | 0.25 | 0.27 | 1199 |
| AI015693 | 0.01 | −0.01 | −0.20 | 0.20 | 0.27 | 1200 |
| R50755 | 0.00 | −0.01 | −0.20 | 0.19 | 0.19 | 1201 |
| W44337 | 0.04 | 0.05 | −0.13 | 0.18 | 0.39 | 1202 |
| H23267 | 0.03 | −0.37 | −0.55 | 0.26 | 0.31 | 1203 |
| AA101850 | 0.02 | −0.12 | −0.30 | 0.34 | 0.21 | 1204 |
| AI628322 | 0.05 | −0.03 | −0.22 | 0.37 | 0.28 | 1205 |
| R94207 | 0.02 | 0.13 | −0.06 | 0.26 | 0.28 | 1206 |
| NM_004347 | 0.03 | 0.32 | 0.14 | 0.35 | 0.27 | 1207 |
| AA960802 | 0.05 | 0.14 | −0.04 | 0.37 | 0.29 | 1208 |
| NM_052962 | 0.02 | −0.42 | −0.60 | 0.26 | 0.25 | 1209 |
| T91946 | 0.04 | 0.14 | −0.05 | 0.29 | 0.33 | 1210 |
| AA531564 | 0.04 | −0.14 | −0.32 | 0.37 | 0.26 | 1211 |
| R96155 | 0.01 | 0.00 | −0.18 | 0.28 | 0.21 | 1212 |
| AI825491 | 0.02 | −0.07 | −0.25 | 0.19 | 0.29 | 1213 |
| N53973 | 0.02 | 0.01 | −0.17 | 0.22 | 0.31 | 1214 |
| NM_001544 | 0.01 | 0.10 | −0.08 | 0.27 | 0.22 | 1215 |
| AA702731 | 0.00 | −0.16 | −0.34 | 0.19 | 0.23 | 1216 |
| AI554655 | 0.05 | −0.04 | −0.22 | 0.23 | 0.36 | 1217 |
| H17495 | 0.04 | 0.50 | 0.32 | 0.29 | 0.31 | 1218 |
| AI209185 | 0.02 | −0.24 | −0.42 | 0.16 | 0.31 | 1219 |
| AA031813 | 0.03 | −0.15 | −0.33 | 0.29 | 0.27 | 1220 |
| NM_004166 | 0.04 | −0.37 | −0.54 | 0.35 | 0.27 | 1221 |
| AA461044 | 0.02 | 0.06 | −0.11 | 0.21 | 0.31 | 1222 |
| N45328 | 0.05 | −0.12 | −0.29 | 0.32 | 0.30 | 1223 |
| N64446 | 0.03 | −0.24 | −0.42 | 0.24 | 0.32 | 1224 |
| AI633617 | 0.01 | −0.05 | −0.22 | 0.23 | 0.24 | 1225 |
| R45159 | 0.03 | 0.22 | 0.05 | 0.32 | 0.24 | 1226 |
| R60898 | 0.00 | 0.13 | −0.04 | 0.18 | 0.17 | 1227 |
| AI621170 | 0.03 | −0.05 | −0.22 | 0.30 | 0.27 | 1228 |
| N99049 | 0.01 | 0.16 | −0.01 | 0.31 | 0.19 | 1229 |
| H18651 | 0.01 | 0.19 | 0.02 | 0.24 | 0.22 | 1230 |
| AA568582 | 0.04 | 0.02 | −0.15 | 0.30 | 0.28 | 1231 |
| AA026871 | 0.03 | −0.02 | −0.19 | 0.37 | 0.20 | 1232 |
| AI559626 | 0.01 | −0.11 | −0.28 | 0.23 | 0.21 | 1233 |
| AA443545 | 0.03 | 0.46 | 0.29 | 0.27 | 0.28 | 1234 |
| R43339 | 0.04 | 0.22 | 0.06 | 0.36 | 0.23 | 1235 |
| AA007369 | 0.04 | −0.16 | −0.33 | 0.28 | 0.30 | 1236 |
| AA960982 | 0.01 | 0.25 | 0.08 | 0.26 | 0.22 | 1237 |
| AA481399 | 0.01 | 0.01 | −0.16 | 0.30 | 0.18 | 1238 |
| AA280005 | 0.02 | −0.17 | −0.34 | 0.23 | 0.26 | 1239 |
| NM_005666 | 0.01 | 0.36 | 0.19 | 0.26 | 0.20 | 1240 |
| NM_000491 | 0.03 | 0.08 | −0.09 | 0.32 | 0.24 | 1241 |
| AA844053 | 0.03 | −0.12 | −0.28 | 0.22 | 0.26 | 1242 |
| R49384 | 0.01 | −0.05 | −0.22 | 0.24 | 0.21 | 1243 |
| AI698289 | 0.01 | −0.16 | −0.33 | 0.23 | 0.21 | 1244 |
| AI680467 | 0.04 | −0.09 | −0.26 | 0.23 | 0.31 | 1245 |
| M90391 | 0.03 | −0.11 | −0.28 | 0.27 | 0.23 | 1246 |
| AF218727 | 0.05 | 0.18 | 0.02 | 0.25 | 0.31 | 1247 |
| H22946 | 0.04 | −0.44 | −0.60 | 0.27 | 0.29 | 1248 |
| N49285 | 0.03 | −0.51 | −0.67 | 0.23 | 0.28 | 1249 |
| N74903 | 0.01 | 0.17 | 0.01 | 0.21 | 0.22 | 1250 |
| NM_001066.2 | 0.04 | 0.14 | −0.02 | 0.23 | 0.30 | 1251 |
| NM_021805 | 0.02 | 0.05 | −0.11 | 0.29 | 0.21 | 1252 |
| NM_004590 | 0.04 | 0.26 | 0.10 | 0.27 | 0.27 | 1253 |
| AA482392 | 0.01 | −0.19 | −0.35 | 0.25 | 0.20 | 1254 |
| AA131826 | 0.01 | −0.04 | −0.20 | 0.26 | 0.17 | 1255 |
| AA947111 | 0.02 | 0.07 | −0.09 | 0.17 | 0.27 | 1256 |
| AI159796 | 0.04 | −0.13 | −0.28 | 0.20 | 0.28 | 1257 |
| AF086537 | 0.05 | 0.15 | −0.01 | 0.32 | 0.24 | 1258 |
| AI147932 | 0.00 | 0.13 | −0.03 | 0.23 | 0.16 | 1259 |
| AA460956 | 0.04 | 0.11 | −0.04 | 0.30 | 0.24 | 1260 |
| AA398249 | 0.03 | −0.11 | −0.27 | 0.23 | 0.26 | 1261 |
| H08161 | 0.04 | −0.23 | −0.39 | 0.23 | 0.28 | 1262 |
| AA281734 | 0.03 | −0.12 | −0.28 | 0.31 | 0.19 | 1263 |
| AA628488 | 0.04 | −0.18 | −0.33 | 0.20 | 0.30 | 1264 |
| AA430519 | 0.04 | −0.06 | −0.21 | 0.22 | 0.26 | 1265 |

TABLE 3-continued

Significantly under-expressed gene activities in samples of patients with infectious MODS/MOF, if compared with the gene activities of patients with non-infectious MODS/MOF.

| GenBank Accession No. | p-value | Mean normalised and transformed expression value | | Standard deviation | | SEQUENCE-ID |
| | | Group of patients with non-infectious MOF | Group of patients with infectious MOF | Group of patients with non-infectious MOF | Group of patients with infectious MOF | |
|---|---|---|---|---|---|---|
| AA468113 | 0.05 | −0.16 | −0.31 | 0.29 | 0.25 | 1266 |
| AI424466 | 0.04 | 0.06 | −0.10 | 0.26 | 0.24 | 1267 |
| AI190760 | 0.04 | 0.04 | −0.11 | 0.29 | 0.23 | 1268 |
| N89992 | 0.01 | −0.06 | −0.21 | 0.23 | 0.18 | 1269 |
| AA046092 | 0.01 | 0.10 | −0.05 | 0.16 | 0.21 | 1270 |
| W35358 | 0.02 | 0.05 | −0.10 | 0.22 | 0.20 | 1271 |
| AA398341 | 0.04 | −0.19 | −0.33 | 0.27 | 0.23 | 1272 |
| H01969 | 0.05 | −0.09 | −0.24 | 0.32 | 0.20 | 1273 |
| AA970008 | 0.05 | −0.34 | −0.48 | 0.32 | 0.21 | 1274 |
| R89846 | 0.01 | 0.14 | −0.01 | 0.20 | 0.20 | 1275 |
| H18639 | 0.04 | 0.13 | −0.02 | 0.26 | 0.24 | 1276 |
| AI016342 | 0.02 | 0.02 | −0.12 | 0.18 | 0.22 | 1277 |
| NM_002184 | 0.04 | −0.23 | −0.37 | 0.17 | 0.28 | 1278 |
| NM_001643.1 | 0.03 | 0.13 | −0.01 | 0.19 | 0.26 | 1279 |
| AA280029 | 0.04 | −0.14 | −0.28 | 0.28 | 0.22 | 1280 |
| AA927949 | 0.00 | 0.17 | 0.02 | 0.16 | 0.14 | 1281 |
| AA625552 | 0.04 | 0.05 | −0.09 | 0.28 | 0.20 | 1282 |
| AA458912 | 0.03 | −0.23 | −0.37 | 0.24 | 0.23 | 1283 |
| AI188025 | 0.02 | 0.29 | 0.15 | 0.21 | 0.22 | 1284 |
| XM_007417 | 0.02 | 0.00 | −0.14 | 0.21 | 0.19 | 1285 |
| AA019529 | 0.03 | −0.29 | −0.42 | 0.22 | 0.22 | 1286 |
| AA401542 | 0.04 | −0.09 | −0.22 | 0.17 | 0.25 | 1287 |
| AI478746 | 0.04 | 0.00 | −0.13 | 0.23 | 0.22 | 1288 |
| AA291522 | 0.01 | −0.33 | −0.47 | 0.14 | 0.22 | 1289 |
| AI493122 | 0.05 | 0.16 | 0.03 | 0.25 | 0.22 | 1290 |
| AI203665 | 0.02 | 0.11 | −0.02 | 0.22 | 0.18 | 1291 |
| R74060 | 0.05 | −0.15 | −0.28 | 0.20 | 0.24 | 1292 |
| AI185721 | 0.04 | −0.25 | −0.37 | 0.22 | 0.19 | 1293 |
| AA437106 | 0.05 | 0.10 | −0.02 | 0.23 | 0.20 | 1294 |
| NM_139208 | 0.04 | −0.07 | −0.18 | 0.22 | 0.20 | 1295 |
| AI922221 | 0.05 | −0.02 | −0.14 | 0.20 | 0.20 | 1296 |
| AA412418 | 0.05 | −0.26 | −0.37 | 0.19 | 0.18 | 1297 |

The changes characterized in Tables 2 and 3 can be used for the inventive process.

The GenBank Accession Numbers indicated in Tables 2 and 3 of the individual sequences are associated with the attached sequence listing, itemized or in detail with respectively one sequence (SEQ ID NO: 1 up through SEQ ID NO: 1297).

REFERENCES

1. Natanson C (1997) Anti-inflammatory therapies to treat sepsis and septic shock: A reassessment. Crit Care Med 25: 1095-1099
2. Geiger K (1995) Frühparameter für Multiorgandysfunktionssyndrom (early parameters for multiple organ dysfunction syndrome). in Hartenauer U (ed.) Sepsis in der Frühphase München MMV Medizin Verlag 19-25
3. Knaus W A, Draper E A, Wagner D P, Zimmermann J E (1985) Prognosis in acute organ-system failure. Ann Surg 202: 658-693
4. Goris R I, Bockhorst T P, Nuytinck J K S (1995) Multiple organ failure. Arch Surg 120:1109-1115
5. Vincent J L, Moreno R, Takala J, et al. (1996) The SOFA (Sepsis-related Organ Failure Assessment) score to describe organ dysfunction/failure. On behalf of the Working Group on Sepsis-Related Problems of the European Society of Intensive Care Medicine, Intensive Care Med. July 22(7):707-10.
6. Pfeiffer L, Ehrhardt N, Kretschmar R, et al. (1996) Endotoxinämie und Multiorganversagen nach Polytrauma (endotoxemia and multiple organ failure upon polytrauma). Anaesthesiol Reanimat 21: 91-96
7. Schlag G, Redl H (1993) Organ in shock, early organ failure, late organ failure, in Schlag G and Redl H (eds.) Pathophysiology of shock, sepsis, and organ failure Berlin Heidelberg Springer-Verlag, 1-4
8. Bone R C, Balk R A, Cerra F B, et al. (1992) The ACCP/SCCM Consensus Conference Committee (1992) Definitions for Sepsis and organ failure and guidelines for the use of innovative therapies in Sepsis. Chest 101:1656-1662; und Crit Care Med 1992; 20: 864-874.
9. Levy M M, Fink M, Marshall J C, et al. (2003) For the International Sepsis Definitions Conference: 2001 SCCM/ESICM/ACCP/ATS/SIS International Sepsis Definitions Conference. Crit Care Med. April; 31(4):1250-6
11. Marik P E. (1993) Gastric intramucosal pH. A better predictor of multiorgan dysfuction syndrome and death than oxygen derived variables in patients with sepsis. CHEST 104: 225-229
12. Bernardin G, Pradier C, Tiger F, et al. (1996) Blood pressure and arterial lactate level are early indicators of short-term survival in human septic shock. Intensiv Care Med 22: 17-25;
13. Marecaux G, Pinsky M R, Dupont E, et al. (1996) Blood lactate levels are better prognostic indicators than TNF and IL-6 levels in patients with septic shock. Intensiv Care Med 22: 404-408

14. Duswald K H, Jochum M, Schramm W, Fritz H (1985) Released granulocytic elastase: an indicator of pathobiochemical alterations in septicemia after abdominal surgery. Surgery 98: 892-899
15. Nuytinck J K S, Goris R I, Redl H, et al. (1986) Posttraumatic complications and inflammatory mediators. Arch Surg 121: 886-890
16. Nast-Kolb D, Jochum M, Waydlas C, et al. (1991) Die Wertigkeit biochemischer Faktoren beim Polytrauma. (Valence of biochemical factors with polytrauma). Hefte Unfallheilkunde 215: 215
17. Hack C E, de Groot E R, Felt-Bersma R J, et al. (1989): Increased plasma levels of interleukin-6 in sepsis" Blood 74: 1704-1710
18. Patel R T, Deen K I, Youngs D, et al. (1994) Interleukin 6 is a prognostic indicator of outcome in severe intra-abdominal sepsis. Br J Surg 81:1306-1308
19. Southern E M (1974) An improved method for transferring nucleotides from electrophoresis strips to thin layers of ion-exchange cellulose. Anal Biochem 62:317-318
20. Gillespie D, Spiegelman S (1965) A quantitative assay for DNA-RNA hybrids with DNA immobilized on a membrane. J Mol Biol 12:829-842
21. Lennon G G, Lehrach H (1991) Hybridization analyses of arrayed cDNA libraries. Trends Genet 7: 314-317
22. Kafatos F C, Jones C W, Efstratiadis A (1979) Determination of nucleic acid sequence homologies and relative concentrations by a dot hybridization procedure. Nucl Acid Res 7:1541-1552
23. Fodor S P, Read J L, Pirrung M C, Stryer L, Lu A T, Solas D (1991) Light-directed, spatially addressable parallel chemical synthesis. Science 251:767-773
24. Pease A C, Solas D, Sullivan E J, Cronin M T, Holmes C P, Fodor S P (1994) Light-generated oligonucleotide arrays for rapid DNA sequence analysis. Proc Natl Acad Sci USA 91:5022-5026
25. Schena M, Shalon D, Davis R W, Brown P O (1995) Quantitative monitoring of gene expression patterns with a complementary DNA microarray. Science 270:467-470
26. Golub T R, Slonim D K, Tamayo P, et al. (1999) Molecular classification of cancer: class discovery and class prediction by gene expression monitoring. Science 286:531-537
27. Alizadeh A A, Eisen M B, Davis R E, et al. (2000) Distinct types of diffuse large B-cell lymphoma identified by gene expression profiling. Nature 403:503-51
28. Feezor R J, Baker H V, Xiao W, et al. (2004) Genomic and Proteomic Determinants of outcome in patients undergoing thoracoabdominal aortic aneurysm repair. Journal of Immunology 172 (11): 7103-7109
29. Huber W, Heydebreck A, Sueltmann H, et al. (2003) Parameter estimation for the calibration and variance stabilization of microarray data. Stat. Appl. in Gen. and Mol. Biol. Vol. 2, Issue 1, Article 3

The invention claimed is:

1. A method of differentiating between the non-infectious and infectious causes of multiple organ failure in a human subject, comprising:
   a. isolating sample RNA from a blood sample from said human subject;
   b. selecting at least two genes and/or gene fragments specific for differentiating non-infectious and infectious causes of multiple organ failure from a group consisting of: SEQ ID NO. 1 to SEQ ID NO. 1297 as well as gene fragments thereof with at least 20-2000 nucleotides;
   c. quantitatively measuring the level of expression of said at least two genes and/or gene fragment;
   d. comparing the quantitative data of the expression level of said at least two genes and/or gene fragments against an expression level of said at least two genes and/or gene fragments of a patient with non-infectious multiple organ failure; and
   e. in the case that said genes and/or gene fragments selected from the group consisting of SEQ ID NO:1-721 are expressed more in the sample than in the patient with non-infectious multiple organ failure, diagnosing the human subject as having risk of infectious multiple organ failure and in the case that said at least two genes and/or gene fragments selected from the group consisting of SEQ ID NO: 722-1297 are decreased more in the sample than in the patient with non-infectious multiple organ failure, diagnosing the human subject as having risk of infectious multiple organ failure.

2. The method according to claim 1, comprising assessing the course of disease in non-infectious and infectious multiple organ failure during therapy.

3. The method according to claim 1, comprising classification of patients as to non-infectious or infectious causes of multiple organ failure.

4. The method according to claim 3, wherein said method serves as inclusion criterion or exclusion criterion of patients with non-infectious or infectious causes of multiple organ failure in clinical studies of stages 2-4.

5. The method according to claim 1, further comprising generation of gene activity data for further electronic processing.

6. The method according to claim 5, wherein the gene activity data are used for the production of software for the description of the individual prognosis of a patient, for diagnostic purposes and/or patient data management systems.

7. The method according to claim 5, wherein the gene activity data are used for the production of clinical expert systems and/or for modelling of cellular signal transmission paths.

8. The method according to claim 1, comprising using a specific gene and/or gene fragment for the generation of gene expression profiles, the gene and/or gene fragment being

SEQUENCE LISTING (1297 sequences)

SEQ ID NO: 1 - DNA, 670 bp, Homo sapiens
  misc_feature (503)..(503): n is a, c, g or t.
  misc_feature (530)..(530): n is a, c, g or t.
  misc_feature (564)..(564): n is a, c, g or t.
  misc_feature (669)..(669): n is a, c, g or t.
gttattggacgaggtgtattaaaataaaatcaaaaatagaaatattaggtatatacacaacagcataagtgaaacacatcatgtgatacagaagtttccattcaaagcttacaggagaaaaatttagtgaacagaaccgcttgaacctcctgccaccgtggcttattagagccttgtagtcacttatgttccttcatatccttgggtataaatagtctcatacacatgctacacaatttagaaaagattgctgaatcataaaaatagccccgaatgtggcactttagctttctagagtacaactaaaattaatacttgatctttaacataatgttcaaatatttgaagcaacaaaggaaactcttatgttttagaaggccctataaggttcttcagagattagaatcctagttcttccaaactacattgtcaaaacaaatctggatataggaaattgtggaaatggaaaagctggactcctaaaaatattccctctaacaccngagcagtttctggaggctcttctcccnttcctgggaggtccaggtgagcccggtgccttcngggtgagcagacagggcagctgtggtgctcacgggctcccctgctggaagagagagagtgtgccgccactcctatgggatgtctagcaggttgagcagggtcaana

SEQ ID NO: 2 - DNA, 609 bp, Homo sapiens
  misc_feature (490)..(490): n is a, c, g or t.
  misc_feature (495)..(495): n is a, c, g or t.
  misc_feature (516)..(516): n is a, c, g or t.
  misc_feature (552)..(552): n is a, c, g or t.
  misc_feature (564)..(564): n is a, c, g or t.
  misc_feature (589)..(589): n is a, c, g or t.
ggcaaggaataacaaaataatagaaactccatatatattagaaaaagatctgtaagtttgagccttatatattattacaatgtggcaatcaagaggaaaactcaagacaactgtgcgctgtgcttgtcctgttttgttcaaaccacgataattttaaataaatagtaatgttcaacattcactgatgacattatctatcaaccacatcacacctggaacacagtagataataaatggcagctgttataccttccttcttgaaacaaaatcctgtcatttcattctcattttaactttgtgttaagcttctacaatccataaaaatgataaaacaataaaatggtccaacattatctagtccagtcttatttttacaaaacattgactttaaaagtccctggagattttaattttactggtttaatctgtcttccctacccttgtttaaaaaaaaatagaatcatgtgtcattattgggttgagtacccgntatcnggaatccttgggacagtggtnttggattccaatatggaatattggcttatattaccngtgagtatcccnatctggacacgggaatcctaatgcncgtggacatcccttgagtgt

SEQ ID NO: 3 - DNA, 599 bp, Homo sapiens
  misc_feature (495)..(495): n is a, c, g or t.
  misc_feature (527)..(527): n is a, c, g or t.
  misc_feature (539)..(539): n is a, c, g or t.
  misc_feature (598)..(598): n is a, c, g or t.
tgcttattgatttttttaagtctgagggaaattacccaaaatgtgtcattccttaacatttaaaaatatgttacataaaaatgagcaactgtgataacaaataaaacttggagagaaaaaagttggctatttccttattcaaggagacagagctaccagaatacatcaagatagcgcacaaattttttaaatccactgccacttctgctgaaacaaaagtcaactgataagaaaattcccattcaaaacaattttaattgtactgttaactcttcctccattttttaatttcatgaagtcataatccaatctgagttggtctgttgggcattagcagacatagtcactggagaggagtgagatgatgtcagagcatggggcacagtatttataaatgtctcctttaagaaagtgtaagtagtatcaagttcagctttcaatgggtaagaaatccccaataccagttgtgtcagcaggaaggaggagctcttgaanggatggagagatttggatgggcccgtgatccnattggattggtnaacctgcattttccccgttaacaagccggtgtggaagtccggtttccaaggctgccatnt

SEQ ID NO: 4 - DNA, 436 bp, Homo sapiens
ttttgagatagagtcttactgtgtcaccaaggctgcagggcaatggcctgatcttgactcactgcaacctcagcctcccgagtagctgggactacaggcatgcgccaccacacccagctacctttttttgatgttgttgtatttctagtagagacagggtttcgccatattggccaggatggactctaactcctgacctccagtgatccacctgcctcggcctcccaaagtgttgggattacaggcatgagccaccacgccccacctgactcccagtctcttattacccaacctgcaattttcaaaaccccagtccgactgctaacctttgacctcttggatttccctccccgcactcccctatctggatgaaggacccacctcaggttcttgttgaagctcagatcttgtaccgctgtcttcttgatctctaccc

SEQ ID NO: 5 - DNA, 877 bp, Homo sapiens
caagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccaacaatgatgttgggagttataaccttgtctcctggtaccagcagcacccaggcaaagcccccaaaatcatgatttatgaggtcagtaagcggccctcaggggtttctaatcgcttctctggctccaagtctggcaacacggcctccctgacaatctctgggctccaggctgaggacgaggctgattattactgctgctcatatgcaggtagttacactgtggttttcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctaaaccctcaccccccccacgggagactagagctgcaggatcccaggggaggggtctctcctcccaccccaaggcatcaagcccttctccctgcactcaataaaccctcaataaatattctcattgtcaatcac

SEQ ID NO: 6 - DNA, 371 bp, Homo sapiens
tttttttttttttttttttttttttttttttttttttttttttttttttttttttttttttcaccccccaaaaaaaattaaaaattaaaaaaaaaaagaaacacaccggcctcccttttggggaaaaaaaggggcccccaaaacccccaaaggggggggacctttgggaaaggcccccaaagggtttggaaaaaagttttgggtttgggcccaatttgggtttaaaaaaaaaaccccctttcaaaaaccaataaaattttaacccaggaaaacgggggggggggcccccgggaaaaaacccttttttggggggcccttttttttttttttacccaggggcccccccaaaaagggggggggggggggggggg

SEQ ID NO: 7 - DNA, 301 bp, Homo sapiens
  misc_feature (165)..(165): n is a, c, g or t.
taacatgtggtgaagtttaattattcaataatggttccaattattaaacatgactattgcataatgacataattggctgtggatgtgcttttgtgtggccacataaactccaggaaactttgtcttcattagtttcattagtcttcatgaggtcaggcctggggnagctcgtttgactcttcccaagtgtggggtaggtgttgatgccttgagagtgccagagtgacacaggtcatgacccacgccagggtgaagtgagaactctcaggggtcacctctccttgttccacatctgtctttt

SEQ ID NO: 8 - DNA, 587 bp, Homo sapiens
ttatgcttgctttttatttagagatttttcataggctgcagtttcacactgaataaatttgtttctgtatctacaccatgaacatacacgatgacagcaagtatttattgaacaccacctcataatatgtgctcgacccagctctcagtgctctctgcaagcctcagtccttgaagtcacccctgagaggcagaagctgtcactgttcccctggcactggggagaaaagggacatgtaggggctgttctgttgcaagtttagagatccacgtggtcagcgcctcaacgctggttccatcagacagagataccggacccgtctaggattccgttgttggccgcaagtgcagaggcgttcgccatacttgttggagatgtccaaattgcagtttgcttcacagagggccaccacgataggcatgttgcaatctttacattgcccatggaggggagtattgccgtgcctgtcttgataatcgacgaaacaccctggttgaggagagtcttgattacctccatctgacaccgtctaaagccagatgaagggcaatgtgtccgtccttgtcgcaagcattaaggtcggctcc

SEQ ID NO: 9 - DNA, 532 bp, Homo sapiens
  misc_feature (477)..(477): n is a, c, g or t.
caacttctatggtggttttattatgaaacaaaataaacctttcaatatcatattcaaattatcaaaaatatagctcaaaccttcctacactgataaaaataatatatatcattcacatcaacatcatgacagctcaaagttagctatttgaaataaatcatcatacttttgaaagctactcttattacatttctaaacagagtgctatttttcctttttctaagagaaactataaagcataccccaaagtactcacattctggctacatttggaaaactatttgaaagattaaaccttcatgtttatctcatctcacaatttacatttatgtattaatttaaatggctacagaactatttaaaaatttattttataaacatggtactacaaattttaaaacttcctgttctaaaagtaactatttaaaaagatttctggaacacaccatcaaaaagatactgttagaaaatttcccnagagtggacacacaccaggcaaatccaggccggaggaattaagacgggtttagca

SEQ ID NO: 10 - DNA, 398 bp, Homo sapiens
  misc_feature (274)..(274): n is a, c, g or t.
  misc_feature (317)..(317): n is a, c, g or t.
  misc_feature (327)..(327): n is a, c, g or t.
  misc_feature (334)..(334): n is a, c, g or t.
  misc_feature (354)..(354): n is a, c, g or t.
  misc_feature (372)..(372): n is a, c, g or t.
  misc_feature (385)..(385): n is a, c, g or t.
gtctcactttgctacccacactggagtgcagtgatgcaatcatagctcactgcagcctcaaactcctgggctcaagcaatcctcccacctcagtctcccaagtagctgggattataggcatgagccaccctgactggattacaggtcttaacaggtggataaacactggttaaatctaaatacaacaatatagaaagcaattaatggtaacatgatttgtaatccatagttatgagttttatacaatatggaaacattaattttgctgaagaantttgtctttggtgaactgcacacacatgtatgtgccataaaancggcaacaangaagganaaagtaaaaactttttcaantaatggtttcactcctangggatgttaaaangggcaatttttaa

SEQ ID NO: 11 - DNA, 500 bp, Homo sapiens
  misc_feature (271)..(271): n is a, c, g or t.
  misc_feature (274)..(274): n is a, c, g or t.
  misc_feature (342)..(342): n is a, c, g or t.
  misc_feature (416)..(416): n is a, c, g or t.
  misc_feature (472)..(472): n is a, c, g or t.
  misc_feature (478)..(478): n is a, c, g or t.
  misc_feature (484)..(484): n is a, c, g or t.
  misc_feature (497)..(497): n is a, c, g or t.
ttttttttgagacagagtctctctgtcacccaggctggagtgcagtggtgtgatctcagctcactgcaacttctgccttccaggttcaagcaattctcccacctcagcctcccaagtagctgggatcacaggtgtgcaccaccacatccagctaatttttatatctttagtagagacagggtttcaccatgtggcccaggctggtctcgaactcaacctccagtgaaccacctgcctcagcctcccaaagtgctgggattacaggcgtganacncgttgcccagccaagatttggggaattaagaaaggaaatacaaacacaactgaggccaaaggaaagantctgacttgattaacattcactggcatttcaggcattccaaaggaatttccatttatttttaacaacttttgtnattttcttttttaaattacagggcagggcaaaggaggttaacaattttttttaatnggttgnttaacnggcacgtgtttanttt

SEQ ID NO: 12 - DNA, 523 bp, Homo sapiens
  misc_feature (141)..(141): n is a, c, g or t.
  misc_feature (523)..(523): n is a, c, g or t.
ctggtataatgtttatttaaatagtaatcttaaaaaggctttatacaaatcatataaacacagtttgacattgttgtttattttttacattgaagaatcacagtaaaagctctcaagttcccgtgatctggctcagccatngaatggtcgaatacctctaactgcaaaccctgaaaaagttaacctgctatgtgacaggttaactctttcccttgttttcttgtcattcatgcttattccttggaccctcatccctgtcaactcccctgccccaccaaagacagaaagcaaccctgtggccctgttgaccacctagtccgggagagtgtggaggtaatgtgtcattcagtacaaggcaaaaaggagatcaatactggcagtggggtttcccaaaggaattgactcaaggagatgggtcagctagcctacccacagataaagataacaaacacaccaaggtgtcccctggccaagtcaaaattgggcccagcgtctttctttctgtcttacgacagagcagccn

SEQ ID NO: 13 - DNA, 458 bp, Homo sapiens
attacagttttattttaaaggatacacatagggcaaagtctgggagagtccaggacaagagcttctcccaatacagtcaggctatgacacgctctcggcacattgatgtattctccggccaggaagctcccccaagtctccatgagcagagtttttattggagttttattacttaggcatgattgattaaatcattggtcacataactgaactcaatctccaaactttcccgccctagagggaagtggctgaaagttctaaccctctaatcctattcctggtctttttggagggcagttcccatcctaaagctatctaatggcccacagtgagtcatctaatcagtaaaacaaaaccattcccatcacacagaaaactccaagcgttttgaagctatttttagggaaccacagacaactactttttcgtttttcttttttttaagagacagagtcttg

SEQ ID NO: 14 - DNA, 3204 bp, Homo sapiens
gccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 15 - DNA, 650 bp, Homo sapiens
gtctcagtcaggacacagcatggacatgagggtccccgctcagctcctggggctcctgctacttcggctccgaggtgccagatgtgacatccagatgacccagtctccatcctccctgtctgcgtctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaagttactactgtcaacagagttacaggacccccgcgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgaga

SEQ ID NO: 16 - DNA, 472 bp, Homo sapiens
  misc_feature (120)..(120): n is a, c, g or t.
gtttccatatggaaccatctgtgtgaattagtcatcagttaggtatagttaacgtaaagagcccctgccattgaaactttgcacaccttctctgctttattgaaggcaagggccagtggnagtgatagcaggggagggaccctccagaaccacccagccctccaggaggccaataagcatggatatcatgtcaggagctgagctgacatatatttactcagaggacattggggtctgtagctaatcctaaagaatgctccgcaacagaaggaaaccaatgcattgtagaaaacaaagggagatggtgcccgaagtctgcctgtttctcttctcttttctttcccatctcaccaccatgtcctctctaacagaattatatttcatctcatatattatatgttactagaaaagtcatttggttccttggtttctctctttatcagtgggctggaaattcctccaaattaaatat

SEQ ID NO: 17 - DNA, 501 bp, Homo sapiens
  misc_feature (458)..(458): n is a, c, g or t.
  misc_feature (484)..(484): n is a, c, g or t.
cattcagtatttattaagtacccactgcgtgcaatgcacagcatggggctacacttatacaaaagagcaggcaaggtgagactatcaaatagcactggtacttggcaaaaactaaacctatcacagcatcccaaggggcaggtctttgaggcaaaggtgatcgggccaactggtagttataaactgggttactagttcttccacttacccttgaaaatagcagaattcaaatagttattcacaggttaggtaggcactaattatttctgcttcatgagtaatcagggtggaagaatttatcaccacctacagtgtccagtcatttcatatctgggatatacagacatccaggtaagaaaattctgaagcaaccttttaccagtggacaccaagccctaaatgttttgtggatctggggaacacccgcagctgggttttaggattatggaagaccaganaggcaggggagagcctccccaatccngaggattattttttttt

SEQ ID NO: 18 - DNA, 944 bp, Homo sapiens
gcaagatggtgttgcagacccaggtcttcatttctctgttgctctggatctctggtgtctacggggacatcgtgatgacccagtctccagactccctggctgtgtctctgggcgagagggccaccatcaactgcaagtccagccagactgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatactactcctatcactttcggccctgggacccaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcaaaaaaaaaaaaaaaaaaaaaa

SEQ ID NO: 19 - DNA, 2173 bp, Homo sapiens
aaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctgg

SEQ ID NO: 20 - DNA, 319 bp, Homo sapiens
  misc_feature (271)..(271): n is a, c, g or t.
  misc_feature (281)..(281): n is a, c, g or t.
  misc_feature (292)..(292): n is a, c, g or t.
  misc_feature (303)..(303): n is a, c, g or t.
gtggttaaacataaaacattcaatttattattttgataactgcaatccttaaaatacataatccaactgaacaattatatgttaatagtttcattctcttcaaatatacaacacattaaatctaagtttatactttggcttcatttctgaggagaagcatgaaagttgctagataagacattgttaaacatttccatcatttattacaaaaaaaagaaattgaaacataacttatgttgagaattaagaggttactaatttcaaaaataangattataatnatttttccccnagggtaataanccccccctaggggttt

SEQ ID NO: 21 - DNA, 485 bp, Homo sapiens
  misc_feature (434)..(434): n is a, c, g or t.
ttttttagatttatatctcattttattggcatccaaataatatacccttcccaaccagaattcaagtttagtatctaagtatatacaaaaagatttacattttaattacaatttgtgaaaaacttcatgttttccttacaactgtactccccttcttcaacatggattatcaagagtagactataattattatgaatttcaagaccacttgttttcacagaaagccatttttaggagttcttgctactagtaagcctaaattgtacttccttgtctggtaatatggagagtgattgctctagtattcttgcctttatctccaggaaagtcatattcctgcttcaaaatgtcagctgttctgaggagtctttaccaacttcacagaacattttggccatgttgtccttgctgctcccgttgtatctcataccctnttttgtctcttaaacccataatttggtcacatgaagttcacactaatggag

SEQ ID NO: 22 - DNA, 485 bp, Homo sapiens
  misc_feature (57)..(57): n is a, c, g or t.
ctctgagagacagagtctcactctgtcaccaggcctgagtgcagtgacgcagcatangcttactacagtgtcagtctcctgagctcagctcttgcctcagtctcctaagtagctgggattacaggcatgtgccgccatgcccagttttaaatttttgtttttataaacagtgttttactaccttgtccaggctagtctacaactcttggcctcaagcaatactcctgcctcagcttcccaaagtgctgaaattttgataagtcctttttacagaggggaagtttttaattttaatgaagtccattgtatccatcctttttttaatgaattttccctttttaatttaaaatgtcagcactaaacccaagatttcatctatattttctgctggtgctatcttctatgagggtttatagttttgcattttatggtctgtaatctatttgagttaatttgggcaaagggtataagggttaatatctcgg

SEQ ID NO: 23 - DNA, 409 bp, Homo sapiens
tttttccgataatagtctctgttgacagtctatttaattatttaaatgtaatcagttagtcattcaatatttaattttaaagttatcaattgtaataaaatatttaatgcttagttaaaaacaaaacaaaacactagtccaaggtcactgatgatgacataactatccaggtaataatagtcccagctgtgcccagcactccctgccccctccaacaacagtaggaggtgggtgcttgctgcccaggctggctcatgagtgggaggaagaacagtgtgttagcttggaaagggccacaggaatcctactgacgtggctgtgtttacgtgcctcctccccaaagccctctctgttctcacacatggcctggtctgtcccaaaggcctcagagtggggcccatcctgaagc

SEQ ID NO: 24 - DNA, 1169 bp, Homo sapiens
  misc_feature (189)..(190): n is a, c, g or t.
gaattcctttgagactaactgaaatttctgacagccccacactctataactttattgtaaattttctgccaaaaatgatgctttcctatacactcctaatacaagtataaatatattatttaatctagtcttaggttgatttaaaattttgaaaattcactccaaacatatgctctgtaaccgtatggnnaccaatgagaagtgtactctttcaaggtaaatctgtgctgccctggtctgacctgggactctggggatactgcgcccgtgtgctgagttactgagacgagccagccctgcagctgtgctcagcctgccccatcccctgctgatttgcctgttcctagagcacagccccctgccctgaagacttcttataggctggtcacacccggtgcaggagtcagccccagtcaggacacagcaaggacgtgagggcccccactcagctcctggggctcctggggctcctggggctctggctgccaggtaaggaaggagaacactaggattatactcggtcagtgtgctcagtactgtcaggaacttcagggaagtcctctgataacatgattaattgcaagaatatttgtttttatgtttctaacttcaggtgccagatgtgacatccagatgacccagtctccatcctccctgtctgcatctgtaggaggcagagtcaccatcacttgccgggcgagtcagggcattagcaataatttaaattggtatcagcagaaaccagggaaaactcctaagctcctgatctatgctgcatccagtctgcaaagtgggattccctctcggttcagtgacagtggatctgggacagattacactctcaccatcagcagcctgcagcctgaagattttgcagcttattactgtcaacagagtgacagtacccctcccacagtgttacaagtcataacataaaccccaaggaagcagatgtgtgaggctgggctgccccagtgctccttctggtgcctctatctgctgagggaagttctcaaactcagtcaggtttggaaagtcatcgggagattttcctagaggaggccagggaggttcctctgaaccctaagcctctttcgccctcatccccagcagaaaagacgtgacaatgcctgtcctgactgaataaagaagagagataagtccagctg

SEQ ID NO: 25 - DNA, 626 bp, Homo sapiens
  misc_feature (412)..(412): n is a, c, g or t.
  misc_feature (437)..(437): n is a, c, g or t.
  misc_feature (469)..(469): n is a, c, g or t.
  misc_feature (554)..(554): n is a, c, g or t.
  misc_feature (612)..(612): n is a, c, g or t.
  misc_feature (625)..(625): n is a, c, g or t.
ctggaacaggaggctaaatttaaggggatcatatttaataaggataaatataaagtcataagcttagaacaaaaaaatcaacaataacaacaaaatggcacaggacagtgagaaacaactaggcttttaaaaaagtctatttcaaagagacatacagcctgttacagctgccaaaatcactggtatcaggtttcattaaaaacaaagtctgaatgaagaaaatgtcattctctatgcaaatcagactacatttgaatatacttagttctgagtgtacaaatttgagaggacttaaaaaatctaaggagaggccaggcacggtagctcatgcctgtaatcccagcactttgggaggctgaggtgggcggatcacgaggtcaggagtttgagaccagcccggccaacatgggtnaaaccccatctctactaaaaatacnaaaaattagctgggtcattttgggcaggcgcntggtaatcccagctactcaggaggctcaggcaggagaatctcttgaacccaggaggcggaggttgcagtgagccgagatcgtgcnctgtgcactccagctcgggcgacagtggaaagacccgtctccaaaaaaaaaaaaaatntaagggggggggnt

SEQ ID NO: 26 - DNA, 750 bp, Homo sapiens
agcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatcgtaataatcagcggccctcaggggtccctgaccgattctctggctccaagtctggcacctcagcctccctggccatcagtgggctccagtctgaggatgaggctgattattactgtgcagcatgggatgacagcctgaatggtgtggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcc

SEQ ID NO: 27 - DNA, 494 bp, Homo sapiens
  misc_feature (469)..(469): n is a, c, g or t.
cggtttaggtcctttattacaaggaaaacataaaaaatctttcaatcagtaagagcacataagtcttaatgatctagtacattttttagtactttgacttactagggtgattcaaagtttcaggaaaaagaaaattcccagtatcattttcttaatcttattaaacccaaacataagaatgccaaaaaatacagagctcacattttgctggcatacatttccaaatttttaatgcctccctgacaggtgaattttaaggataaaaaaagcagacactttcaaaacattccttgtgatgaagtagaaaaagccctggataagtggccagctacactggatttttgtctcaattcttccattaactttacagtcttcagcaaatcccttaactttgagcttctatatgtagtgacatcattataagtgctgtggtattaaaatgtgataaacatagatgaaagcattttgnaatgtttggaatactacataaatac

SEQ ID NO: 28 - DNA, 858 bp, Homo sapiens
gccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggcgtagtggtggcaggacaagagaaggcattgagctttttctttcattttcctattaaaaaatacaaaaatc

SEQ ID NO: 29 - DNA, 446 bp, Homo sapiens
taggtctttgtaatttttattattcattaagtttcccattatagaataacataataatattgcagcaccctagaacatagagaagagaggggaaaatcattcacaatcattatagcctgacattaacagtattagcatttttgtgttttctgagccagtatttttcctgttgatgttaaaccaggctctagctataatcattatgtatgaatatttctatgcatattttataagtatctaatcttagtgtgcaaataattttctaccttttccacagtattttcttttgtaagctatatatatataattgtataggctcactaatatcatttagtggttaaataattttccatcttgtgatatcatacacatacaatgccatagtgatcactcaaaacattaatttagtgaatgaaattgaacgactcatagtggcaacatcccct

SEQ ID NO: 30 - DNA, 264 bp, Homo sapiens
  misc_feature (223)..(223): n is a, c, g or t.
  misc_feature (247)..(247): n is a, c, g or t.
  misc_feature (253)..(253): n is a, c, g or t.
  misc_feature (262)..(262): n is a, c, g or t.
tagcaggtcataattctacttttattcccacattttgtatctcaggcaacatgaactaaatagatccacctcagcagtggaaaaaggttttcatgaagtttttctaagccatgaaaatggaagattcactctcaaatgctgcattctattcccagtgaaaaataacaatcttatctgtcaggtagaaaaatttttgtaacgacaatctgaaaaacagggactnaaaaacaagtaggggagtttaacnttctcncacatatancg

SEQ ID NO: 31 - DNA, 451 bp, Homo sapiens
ctgaaagtttttttcctgatattttatagttcttataaaatatcaagttatgttgattttcatactttgtcatataccatgttattatgttacttcatgtttttaattcttaattcattgaaatctgttttttagcttctcctatctgatttacttgcaaaataaataaaatctttgatgagaaaactgtgctgttacatttgctttttccttaccttacctctctttaaggtcctccacagatacctgtgactcagactggctaacattgagtttgtttctaaccctccaccagtttctggactactccttctttatcctttcctcttatattccagttttagtaaatgaaaccaacatccacccagttaacttcctgattttcacaacccttatccagttggtaagcagtacccacaaattttacatccagatagctctcaagaaaatg

SEQ ID NO: 32 - DNA, 873 bp, Homo sapiens
acttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgtttt

SEQ ID NO: 33 - DNA, 920 bp, Homo sapiens
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 34 - DNA, 468 bp, Homo sapiens
ccttacacgtccatttattaaacaagttccttcatgacaatttaatacaatagttattaacgattagtgttgagaaaattatttccctctacatacaaaaatacagatttgaacactatgaaaaagatcaagacaagtaccatgaaaaactggtccttcaaatgaaagggggaaaattgagggcaatgtgaggctttgctcgctgtcggggacaaatcaatagcagcaaagctttggggccccaacccactccatacatacagacttgaacccaaaagccaggccagccaggggacgcccacccagggcttccacgtcagctggaaaaaccaaacacataaacctaagtttgcccaacgggttccgcctccagaaagcccacagttgtgtctttaactggccgaattgaaagagacttgatgagtaaaatgtgatagttgttaacattgccccccaaaagtggcacca

SEQ ID NO: 35 - DNA, 422 bp, Homo sapiens
  misc_feature (44)..(44): n is a, c, g or t.
  misc_feature (49)..(49): n is a, c, g or t.
  misc_feature (422)..(422): n is a, c, g or t.
tcagggaagtataagcaggttttattaagatgccagggcgacanaccanggtcagagctgcggcaggaacgccaggcagggggactgagtgtgcgggagagggcggggcacaggacagctgagggaggggtcagggtgggtgcgcggtgacggggagggcaaaggtggtgtcagtatcttcattttgaggattggggttcagagcacttctggggtgtcagctcctccttgtccccccgtgggcttccgtagactggaaagaggacatgaagagctctgacagagagcagcagaaactctggaactgtttccagagggcctgcacttgcatggaccagggccaccaccttctcctttcacccaggccagaaccccgttgccaccaggtcttgcagccgctgcagcatggccttggaaccatn

SEQ ID NO: 36 - DNA, 561 bp, Homo sapiens
accacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 37 - DNA, 191 bp, Homo sapiens
caacttcagcattcaattttattatagtcccatctccctcaacaaacaagatcagcagccagtgtgggatggtgctcaatggggctccacttcccactagagtgtaagctgcttccacgcatgctactgcgtgctccgagccatcgcagcggagtctcttctcacccagctttgatggtggggcgactccc

SEQ ID NO: 38 - DNA, 478 bp, Homo sapiens
  misc_feature (406)..(406): n is a, c, g or t.
  misc_feature (448)..(448): n is a, c, g or t.
  misc_feature (466)..(466): n is a, c, g or t.
cactcccgacgcatttccatagcgtggggagaggctgtgtgagctgaattaggaagtggggcagccagctgcaacttacgacaatatttgtgatcggaagagggcagccacatggatctttccctcctctcccttcctttctggttaaacgtaaaaaacagccgagtgcaaagggaagggctcatgccggcgcaggctgctccccggcgcggcatttccccggcgctggccgcggccccggcgggcccccgtctgggtgctcgccttccctggattccacacatttcagcgagcctcgtaaacacaatgaacccggcagctccgcagactcgcaccgcgaatttaaggtggcaatttgtttacaacttttcctcccccgaccaggccctaaggagaggcggctcanaacctggaaaacgggggggatatctttttccgagaataattntttaagggagcagagatntcatgctcaaca

SEQ ID NO: 39 - DNA, 924 bp, Homo sapiens
gcacagcagcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtactta

SEQ ID NO: 40 - DNA, 456 bp, Homo sapiens
  misc_feature (444)..(444): n is a, c, g or t.
  misc_feature (452)..(452): n is a, c, g or t.
gttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatggacgatccaggatgatacaatcacttggatgacagaaggtaagcctttcttacaattagattttagcagataattttaccnctaatatnaatg

SEQ ID NO: 41 - DNA, 423 bp, Homo sapiens
  misc_feature (252)..(252): n is a, c, g or t.
gttaaacattttatttatgtggcactctgaaacgagcaacctatgaaggcataaaataaaaagattttttttttaactcgggaggtaaagctagatatatcaattaggaactgattcatggtgtgatgtacacgacatgttgaaagaatgccaaaaaggcgcaaaccatcatacattaatacaaaggacaaaaacaaaaaaaaccccagcatcttcttgctatgaggcaataaggcactgctaagagacttnagcaccaaaatgattctctacaaattccttcctttttatactgcaaatactgcattattatattcaaacctttaaaaactaggtaatacttaagatttagagtcaacttactttgtgggaaattctatttgctgcttcttttaaaaacagattaaaataagctcttaaaaa

SEQ ID NO: 42 - DNA, 176 bp, Homo sapiens
ttctcctcgttccacaccgcccactggctcctggtccatcgtcgtcgccaccacagggctgctggcgccgcagcgcccgcctcgcgccgcgcctagccaagtctctgagaaggggactcgccggcctgaggggcggggccagcccgcgcctcgcctagcccgccgggctccgcacc

SEQ ID NO: 43 - DNA, 1831 bp, Homo sapiens
agccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtcaaaaaaaaaaaaaaaaaaaaaaaa

SEQ ID NO: 44 - DNA, 2486 bp, Homo sapiens
ccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagtagctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatctctgcgcgtgggggggctctaactgcactttcggcccttttgctcgtggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggcccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 45 - DNA, 431 bp, Homo sapiens
  misc_feature (2)..(2): n is a, c, g or t.
  misc_feature (4)..(4): n is a, c, g or t.
  misc_feature (361)..(361): n is a, c, g or t.
  misc_feature (382)..(382): n is a, c, g or t.
  misc_feature (414)..(414): n is a, c, g or t.
gncnttaaccgttaaacatttttattgtgcaggcttgtaacctttacaggacatgcatgataaaaaattgtaaaatatatcagtaagcatataaaatttcagcaatcttttggaccagtaattgatttgcatgagggactaagcatctatgtagaacagacatgtcttggaatacacagtttacagattgaatcacaaagccatttcctaagcgattttcttcatataaagataaaaatatctttacatttaaaaagtatgcagtatagcacattttcagttatgtacacagtttaaaaggtaaaactatatccatgccagtgtctgttttaaatggcaaaaaggtcaaagtagggtaacnggttgggtaattaaagtgtcngggaagactgggaggagggcaaaattcaagcngggtttcccataagtgt

SEQ ID NO: 46 - DNA, 848 bp, Homo sapiens
agcggcctggctaactcctgccaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcatgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggttgccccacctgagcccccacccgggagcagtgtcctgtgctttctgcatgcttagagcatgttcttggaacatggaattttataagctgaataaagtttttgacttccttta

SEQ ID NO: 47 - DNA, 397 bp, Homo sapiens
gcatttgaaaagctaagaacagcctttattggagaaagtaggataaagacatttccatatatgttcatgggaatttaccattcaaatttaccattcaaactgggggagtagagatcagtcacttttgccatcttatctgtttaaaactctttcaagaaaagaaaagaaaagaaaggaggagtctctttcaagaaaagaaaaaaaggaatactgtgtaagaaccacagaaaaaaagctaagtaggagcagatgtgggtgctctttccttaacagtcagcatagaatgtagagactgacattttctttaagaacagattattataactaagcaagaaaaagtatgtgtacataagttggtcacagtgacacttggtaggaaaatataagtagctgtaaa

SEQ ID NO: 48 - DNA, 1039 bp, Homo sapiens
tgcctgtcttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttaatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttct

SEQ ID NO: 49 - DNA, 401 bp, Homo sapiens
tttttttttttgaagttaaaggacactttatttactgacagattgaaaactgtaactccaggtagtgcaaaatgcaccacaacccaattacaaagaacaggtgttaacacacaatgtttaaacaatgctacactcatttttggcaaagtgctgtattgttcagtctgtgtacaaaactgaccatctatgaaccaatcagtataaaaaatttctataaaaacaaaatttagacagtggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcatgccctg

SEQ ID NO: 50 - DNA, 1429 bp, Homo sapiens
cgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaa

SEQ ID NO: 51 - DNA, 4079 bp, Homo sapiens
cttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcgagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatcaaaaaaaaaaaaaaaaaaaaaa

SEQ ID NO: 52 - DNA, 1124 bp, Homo sapiens
cttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaag

SEQ ID NO: 53 - DNA, 2276 bp, Homo sapiens
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaaaaaaaaaaaaaaa

SEQ ID NO: 54 - DNA, 3700 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 55 - DNA, 1782 bp, Homo sapiens
tagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgatattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacataa

SEQ ID NO: 56 - DNA, 562 bp, Homo sapiens
tttttttaatggaatatatttcctagagacaaaaatctttagcagagaaggtaacattaagtttggcacttaaacattttgaagtaacatagttgagaaatactatgttaaaagttatttattttctaaaatgtacaagtgactgactcatttttattatcactcatgcactgtaacagtctggagagcagcaggttgcttgaagatgcaacaaatattctttcaacacttcaataaacacaatgtaaacattcactttaataatgtttcctttgttaatgcaaaaccgagtgcattttttccttccctctggctgagctatgactagctgagtagcaacagcagagtgctgaaagaatttttcaacagcaatttgcttgttctaatttacttttcaaggttgatgatcagaatcattatgttgcttgcaaaaagatctatttctattaatttgatccagtcattcctcttcttctcatcatatttagtttccctggcagcttcaccaagtaagttaattgaatcagaagtgccattaccactccagttctggtttcatata

SEQ ID NO: 57 - DNA, 2154 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccagaccttttgagttcaactgatcaaaccaaaggaaaagtgttgctagagaaaattggggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggta

SEQ ID NO: 58 - DNA, 443 bp, Homo sapiens
tgaaattcaggcgatttattgtaaacaggataaccctagcactccaccatactggctgtgtcacatgctccctctttcacatcaactggtcaaaaaagaagactttcttaagaagcctcaggtaactaataacttagttccacaaatctcatttactaagcactgcgtaaactgcagtatctggggtagtctgttattgctcatggactgcagcttggacccatctaaatgaatccattagtatgcctgagtgatcaacagcagctctagatccaacctggaaattggaaaatgctgacgcataccaaacaattgcaggttcatggaagactacatgagattgctctcagatctcttcatgtgtcattctcataaaaaaaacacttaaatttcacccattttttaaaaaagagctaaaagttactcaatagcacataattttc

SEQ ID NO: 59 - DNA, 370 bp, Homo sapiens
tttgtgtctatacataaagttttattagaactaagccaacttcatttatttgcatattgtctgtggctactttcacattataagagaatctaataaccttataacagaactattgagcatgatgttatgtttaggtgcaacagagacctacaatatttactatataactctttacagaagatgtctgccaacttctggattagagaaacagcttttaaaatctcattttctttcattttgaggaatgatttcgacatctctttatttattcatttttttctcagtctgtttgtgatgctataacagaacacctgagatagctcatttataaatcatagaaattcattggcctatggttctgggggctgga

SEQ ID NO: 60 - DNA, 1720 bp, Homo sapiens
ctcctcccctccccctccgccctcctccgctccgggccagcgcggcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaacttctcagcatatatat

SEQ ID NO: 61 - DNA, 4465 bp, Homo sapiens
caattgtcatacgacttgcagtgagcgtcaggagcacgtccaggaactcctcagcagcgcctccttcagctccacagccagacgccctcagacagcaaagcctacccccgcgccgcgccctgcccgccgctcggatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtcttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactatcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactattta

SEQ ID NO: 62 - DNA, 466 bp, Homo sapiens
agagaccgaaggctgggggcgcaggcggcgcgtaatgcaggccgggcccgggcgcgccgaaaccagggccaccgaaaggcggcgggaaggaggcgcgcggaccgggcgcgggcaggcgcgcggggccgtcggggctgagcggcggtgtgtcgggcggcggcggggggcggcccccgggacctcgcatgcacgaagccgccgggcccggggcgccctcgcgcttgaggccgcgcggtccacgggtcagcccgggggcgcagccgtagccgccgccgccgtccgcttcagggggctcggccttgaccaggcggccgggcggcgccagcagaaagcggccgtgcagtgcgggccccggcggcgcatccagctcgggtcgcagcagctcagacaccaggccacccgcgggggcgctgtatggcgtgggcgcgccgggttcggtgtaatagaacgcaggcggcggcgcgtg

SEQ ID NO: 63 - DNA, 584 bp, Homo sapiens
  misc_feature (1)..(1): n is a, c, g or t.
  misc_feature (125)..(125): n is a, c, g or t.
  misc_feature (264)..(264): n is a, c, g or t.
  misc_feature (346)..(346): n is a, c, g or t.
  misc_feature (422)..(422): n is a, c, g or t.
  misc_feature (492)..(492): n is a, c, g or t.
  misc_feature (505)..(505): n is a, c, g or t.
  misc_feature (532)..(532): n is a, c, g or t.
  misc_feature (552)..(552): n is a, c, g or t.
  misc_feature (557)..(557): n is a, c, g or t.
  misc_feature (581)..(581): n is a, c, g or t.
nttttttatatagtaaataaactctatttatctgtttctcagagatgacactgccaacaatcacagatttgcatacaatacagttatgtattggctattcacaatttacagtagtgttttttccnctgaaaaatataagtacaaaagctaagtaaacaatgaggtactgccatttgggattttttacatgtcttagcttaaagaactggtctttagcaaatattcaacagatcaacctgaataaaatagtcaattaaatgctcnaatttatcagaaaaaatccactaagtttcacctcaaaatgtattgcacaagtctttttaaaaaatcaccctaaaaataaatnggaaaggtaagccgttctttaaaaaaatgggatgaaaggaatattatgtaagcccataaagcaggttaagttatcnaaatatcttttaaacaacataaaactcttcccaagagaaaactggagaaaaaactatcaccatttctccnctggataaaatcnattttaaaggcagtctgcaacttatcngtgggccagattttcctggnccttnggctacatgaggggcccggatggncac

SEQ ID NO: 64 - DNA, 453 bp, Homo sapiens
  misc_feature (63)..(63): n is a, c, g or t.
  misc_feature (72)..(72): n is a, c, g or t.
  misc_feature (354)..(354): n is a, c, g or t.
  misc_feature (364)..(364): n is a, c, g or t.
  misc_feature (426)..(426): n is a, c, g or t.
  misc_feature (438)..(438): n is a, c, g or t.
ttttttttttttttttttttgaaacagttaagatttttgtttaaatttattttttgaactggnaataatttnacatgtttcaaaattccaaaaatataaaatgataaagagtgaaaattattcctcatcactgtcctcccaattcttctggccaaccagtatgccacttttaccctttcagagattatgtgtgtacatataaacaaatgtttcttatttatttatttatttttgagatggagtttcgctcttgttgcccaagctggagtgcaatggcacaatattggctcactgcaacctccacctcccgggttcaagcgattctcctgcctcagcctacggagtggctggggnttaggaagtntgcaccaccacacccagcttttgtatttccagtagagatgggggttttcaccgtggccggtnaggtgggttttngaactccggacccca

SEQ ID NO: 65 - DNA, 504 bp, Homo sapiens
  misc_feature (497)..(497): n is a, c, g or t.
ttgtggagatgaggtttccctatgttgaccaggctggtctcaaacttctgagttcaagtgatcctcctgccttggtctcccaaaatgctggaattacaagtgtaagccaatacaatcagccttaagttatttaaattttacctcttttttttttttttttaatgagacatttcattaatctttatcacttttggcattatttgtcaactgagggagaaattaactaattatttcacatttacttttgaaggccagcagtaatcccaggaacttgagaccaacctgggcaacacagggagaccctgtctcttgaaaacattttttaaaaattagccaggtatggtcgaacatagtggctcatgtctgtaatcccagcacattgggaggccgaggcaggtagatcacttgagctcatgaattctagaccagcttgggcaaacatgggcaaaaccccatctctaaaaaaaataaaaaattagatgggtgaggtagcgccngtgccag

SEQ ID NO: 66 - DNA, 1552 bp, Homo sapiens
actcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 67 - DNA, 2544 bp, Homo sapiens
gggtagctgcctgctcagaacccacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacatt

SEQ ID NO: 68 - DNA, 608 bp, Homo sapiens
  misc_feature (509)..(509): n is a, c, g or t.
  misc_feature (511)..(511): n is a, c, g or t.
  misc_feature (593)..(593): n is a, c, g or t.
tttttttttttttttttttttagagaaaagctaatctctttaataaatggtgcagggccatttaaatatttatattcagaaaaataatactagacccttgtaccttgccatatatgataatcaactaaaactaaagacttaaatgtaatgccatcaattatgaaactattagagaaaaacataaaaaaatgctttataacattggacggtgaaaggattattaaaataagatttcaaaacatgggcaacaaaatcaagaataaacaaacaacattatgtcaaactaaaatgctttttcatattaaaaaaacaactaaaagtttgaagagacagcttaggcgatgacagaaaatgttttcatatacatgtgacaaaaggctaatattcagaatatataagaaactttaaaatctcaagataaaatacacttataatctaatttaaaaaatgcagaagatcttaatagatgtatgatcaagagagatacaaaaatggcgtactggaaccananagatgctctacattactaatcaccgaggagatgcgaatcgaactgctatgtagtacgacatcattcccatagaatggctatnatagaataagtaatt

SEQ ID NO: 69 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 70 - DNA, 406 bp, Homo sapiens
catgatgatttaatacaatattaatcatatagttactgagtgcctactatgtttcaagcattattctaggcaacgggaatacagtagtaaaaaaatttttgaattgaatgttttagccaaagcaataagacattaagcagataaagaagcatgagtattgggaaggaaataacaaaattattattctaagtgatataactataaaaagaaaagctgtcaccagtaaataaatacaagaaaaagtacagtcatatcttggagatactggaagtatagctgcagaccactccaataaagttattatcacaataaagcaagtcacatgaatttttgtttcccattgcatataaaagttatgtttacactatattatagcctataaggtgtgcaacagcattgtatctaa

SEQ ID NO: 71 - DNA, 449 bp, Homo sapiens
  misc_feature (346)..(346): n is a, c, g or t.
  misc_feature (401)..(401): n is a, c, g or t.
  misc_feature (423)..(423): n is a, c, g or t.
attttccatccccttttatttttatttgcaaatcttcaaagccaagctccagctttcttaatcacattgtaagtacactatgttgttcccttatcttaatttcttattatttgttgcacacacaaatgtgctcacccacccacatccccaacacaaagacattcagcttctgaactttttcctccacgttaccactctctcccatccagactttggaaaagcgaaagacaaccagaatatattgaaggtatctagtccgatttgtcatttaagttgatacatgagtttgaaaaatcaaacaattcgcttgaacatgcattgatttagaatgtgtctaatttatccnttctatcaggaggaaaaatatttggatgattccctcaggtgacatctaaattccnaattggtggatttcaccaaagnctacataaaaagtggctcccagtgaa

SEQ ID NO: 72 - DNA, 2339 bp, Homo sapiens
acgcggtgccgcggggcgggagtagaggcggagggaggggacacgggctcattgcggtgtgcgccctgcactctgtccctcactcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaaaaaaaaaaaaaaaaaaaa

SEQ ID NO: 73 - DNA, 2010 bp, Homo sapiens
attcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctg

SEQ ID NO: 74 - DNA, 379 bp, Homo sapiens
  misc_feature (376)..(376): n is a, c, g or t.
ttttttttactcttccacatccttttatttactattttctgatttttaaaatgacagtggcaattaccatttatactgtgttatttgtataagctgttaaacacaacattgttaaacacaacgaaaattcatttttctacctgaaagctgtatcatagaaaattattttcaagtttatattcaacagcttaataatgttcaaaccagggctgggcgcggtggctcccagcactttgggaggccgaggcgggtggatcctgaggctaggagttcaagaccagtccggccaagatgggtgaaaccctgttctctaccaaaagtacaaaaattaggctggggcgcggtggtggggcgcctggcaattcccagcttaccnggg

SEQ ID NO: 75 - DNA, 1857 bp, Homo sapiens
agttcacccaatggacctgcctactgcagcgtaggcctcgcctcaacggcaggagagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaaaaaaaaaaaaaaaa

SEQ ID NO: 76 - DNA, 1778 bp, Homo sapiens
gggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccctaaaaaaaaaaaaaaaaaaaaaaaa

SEQ ID NO: 77 - DNA, 830 bp, Homo sapiens
cccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagag

SEQ ID NO: 78 - DNA, 1805 bp, Homo sapiens
gaaaactcaggcttggaacagcacctcgcgcgataacctggcgtcctcggccttcacaataaaaactcttcgccggaaaacgacctttccccgcccactgcgctgacaccggaagcgaggcgtgtctgggagatcactccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggccacggcagccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggccagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagt

SEQ ID NO: 79 - DNA, 395 bp, Homo sapiens
tttttttttttttggcagtaattcaacaaacattttattaacctctactaaaccatatttattatttatggccaaatcacagaatcctgaagttagagactccaaggagaaaatgacactcctggctgagaatgacttctgtctcacagcgccagtgcatcctctcccatttcctccaattgataccagcgaagatgcacctaaagatggaaactcagtagtatcaatgcccaaaatacataatctggggggaaaacaccactagtacctcaaaaggcagactccaggtttgaattctggctctactacagaatagccggtgaccttaattttcttacctggaaaatagagataataagggatgatttcatagtcctgaggatttgaggaggtaa

SEQ ID NO: 80 - DNA, 392 bp, Homo sapiens
tttggctcttttaaacaaattttactctattaaaattggagacaaacatgtctgccatctctcactttggtagtagggagtaaggggtgccgtactcaaccagggttcctaatccacagtttgtggttctcaaattttgcactgatatgccgctagacactgcagcaagctcacagaactgccaaagaatatttaaaaaatttcaaagtggcaacagtggcatctgtcagataccaggtgttgagttgtttggacctaactatgtattaacagaactactagttatttcttttagtttaggggcactgcaaagcattactgagatcccaaaggcatcctgaatgggaaatgtttggcaggctctctggggctcagtgcaccatcaccatgtc

SEQ ID NO: 81 - DNA, 382 bp, Homo sapiens
  misc_feature (292)..(292): n is a, c, g or t.
tttttttcacagaacagggtggtttattatttcaatagcaaagagctgaaaaatgtcgggtcccataaaggagcagaacctgacccagagcctgcagtacatttccaccccacaggggtgcaggctgggccaggcagggccaaaggcagcagaaatgggagtaagagactgtgcccactgagaagctctgctgggtgtgggcaggtgggcatgagatgatgatgatgtagtgtaaggaccaggtaggcaaaacctgttcaggtcttgttgagtgtccagagtggatccaganaggctgagggggtcgtcagagggccgggtggcccgcagccctttgccgttatgggcctgcagaaagttatgcttgctcatccgctgtttg

SEQ ID NO: 82 - DNA, 510 bp, Homo sapiens
  misc_feature (10)..(10): n is a, c, g or t.
  misc_feature (160)..(160): n is a, c, g or t.
  misc_feature (400)..(400): n is a, c, g or t.
  misc_feature (502)..(502): n is a, c, g or t.
taactgcaanatcctttcaacaaatagaagctcatctggaagcttgtatatctatatctgtatgtatgtatgtatgtatgtatgtatgtatgtatgtatgtatctctatctatctatctatctatctatctatctatctatctatctttccatctctatntcatccagataaatggatcactgcattgcttgaattggcaggggagttgggggtacggccctacctgcttgtccacctcacttccccacctctctcagtccttgagaggctccttggagacccctagtaccctagtactccaaagaatacagtctgagaacttctcactactcttcagtgtcatttcttttaggctatcaaatttttaagctggtcatcctttataataagggtcacaanggtaagtttgaaccgggaaacatagggcctttttggtttcctaactaacctgactggtgatgttgaaaagccaattgggcttaatgttcttctggggtcganatgggttt

SEQ ID NO: 83 - DNA, 5937 bp, Homo sapiens
ctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaggaaaaaaagtttcatgatatctgttgttggcagtttttgtttatctctgacagtttttagttaaatgtttagatcctcagaactacattagtgcctactattaacttactctgtctcttgttaaaggctaaatctgcgcttctccctggtgccagcaggttcccctcacagtcaatgcagtggtatagcatatcctcacatttctagtgcccttgagactgtgctatggaaccaatcttgaacatacatgcattgacttgacaagttactgagtaagcagcatattcagcaggtgccactacatgcctactctgccagacactgagcttggggccctagggaagatagagaattatacaaggcaaagtccttctctttagggctcttacaatctatcacttccaaaaagtaaatggtgactgataaaacaattggcagaacctgtttgattactgtgacagtcttaatgataccataaatcaatattagaaagctagttgacttaaagcctgaaataatgggagttttctcctccacttattagaataaggaccctcagtgactaattattgtgggtagggtcaagattaactagttttatacagagttctgctgtaaatagtcattttgcatttgattagtgcagttctctgaatcataaagcaagttttacctctctgtacatgtttttgcagacatacttgaaaagctcacttaaatctaggtgcttcaattcactttcttgagaggacaaatgaaaagctgtggagaaaatgtcctcattaaagtattaaagtgtgggcagaattacaattacaaagtgccagccaccgaataaagataaaagttcagttcttaaaatgagtttttatgagataacagtcagtgatcttggtgttaccgggattccacatggggcagtgggaaagagttcaggttttgaaggtaacctagtttagatttgaattccagctatgtgacattgggtaaattagtagtagtcctgagcctcagcgtcctcatctataaaatgactggcgaaaatacttcacaagctcattttgagcactttaggaagtaagtgaaagtacctaaaatagcaggcacccaattgatgattttatatcttccttctttgcttgcagtgatttcaggatgtcctcatatctatttataggtctaaaattatatcttaaggtatgttgtagaataaattaaaaggataatctaaatcaccatttagattaagcttgacttgcaaactaggaagaagcacctaggctttctttgaaaatatttttttggttcgttttggtaaagctctataaattggtatctattattttaccaatttttttttagtattaagtccatttagaactaaccatattatttatggaataattagcatgaggaaggtataattgcattttttttttttttagacggagcttgcactgtagccccagctggactgcagtggcgtgatcttggctcactgcaacctccgcctcccaggttcaagcgattctcctgcctcagcctcccgagcagctgagactacaggcgcctgccaccacgcctggccaattttttgtatttttagtagagactgcgtttcaccatgttgggcaggctggtcttgaactcctgaccttgtgatccacctgcctcggcctctcagagagctgggattacaggtgtgagccgccgtgcccagccattgcatttttattcacatacacattgttaatgtggaacaatttaacactaatctcatcagagagcgagatgaatgtggcaattgctcattttattttgcatatattaaattgagtaggttcagctctaacataccttaagaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacggtctgacttgctttcagtattcacaagttctttccagtttccaagtcttttcctagcagtaatttaggggagacagaggagtttcatgtaaagagcatgcagtttggagtcagaacctgggtatgactctgtggccttgatgaagcaagttacttaaactcttgagttttagctttctcctttacaatgcatgaatgcctatccccctacaaaacaaagattaaatgtgatgatgtatgccaaggtgctttgtatattgtaaagtgctatataattataagatgttctaaattttcaaggatctaaaccagggattggcaaacgtttttccagggagtaaatattttacgctttgcatatataatttatggaggtgttgagaggatagattagacacttgaagtactcaggatagtgcctggcatgtaggaagcacctggaaaatattcgctgtgattaccatcagtccattttaccgaggaaggagccaaggtccaggcccactgaaggacttgcataacattacaatagcagtggcagaaccagccatgcttctgcaaatcacaacctctttgagcctctgtcacctgaactgcaaaatgagtgggttagacaaaatcatctgttgggacctcctagttccacgtgctatcattctactaactggcaccctaaggttgaaagtgcttatctgctttccaatgtggcttccttacagtctggaactgacaatatgcaggagcagtaaactggcagaaaaccaggaatcagagaaagaaaatataatttaactttaaagatgtaaattatatatatagtatattatatatatttttaaagctttatatgcctcaaatatcagggaaaggagccaagtccttggtatttagtttggtgaatacttgcattgaatacatgtcaagatgtcaagtcatttttgaatgtgtctcagggatttctatgctacacattcttttaacaaatcaagtatttatgtacacatgttcagattttttgacaaaatgattaaaataatgagatggaaaatga

SEQ ID NO: 84 - DNA, 345 bp, Homo sapiens
tttgctatacaataaaatgctttattcagccacagctttctaaaaatagatgtggcatcaaaatgcgcattcatcaaatcttgaaggagtttcaaatctttagagtgactctgaactctcgttttggttgacacaataatccataaaaacaaataaagcacccattctgatctggaaggggtaacgaggtgaaaatattgataagccaaagtgacagcctcttttgtagacatgatcctgcctaaatttctcatgcctcacaaaagagggccctgaattccctgcttctccagagctccacgcagtccttgaagcactctctggctgtctctgcaagtggctgaa

SEQ ID NO: 85 - DNA, 865 bp, Homo sapiens
ctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcctggatgcccacccctgctgccgccactggctgtgcctcccccgccacctgtgtgttcttttgatacatttatcttctgtttttctcaaataaagttcaaagcaaccacctgtaaaaaaaaaaaaaaaaaa

SEQ ID NO: 86 - DNA, 2960 bp, Homo sapiens
cggggccccaggccgcggggcggcgcgggacggcgggcgccggcgccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgcgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctttttccctactgcagtgaggagaggccgccgatcgtcaagaggatagggagacaggagttcctgctggcgggccccggagggctgggcatgtttgccacagtcgcagggatatcccagcgtgcccccgtgcactggtcggagaatgtgattggggcggctgtgtcctttccatacgtcatagcgctcgatgacgaattcatcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaacgaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaatgaccaggctctatgaatgtacatggaaaacccctaaaaatccccaaaacagaaacatacaagagttcacctgtccaggtacatagtaatccaagacagaggtctactttgaaaaaaaaaaaaaa

SEQ ID NO: 87 - DNA, 1525 bp, Homo sapiens
attcggcatgagggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaaaaaaaaaaaaaaaaaaaaaaaaaaaaaaaaaa

SEQ ID NO: 88 - DNA, 2653 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 89 - DNA, 1645 bp, Homo sapiens
accgcaccaagcgggtggctgcaggagctcgcccatcgcccctgcgctgctcggaccgcggccacagccggactggcgggtacggcggcgacagacggattggccgagagtcccagtccgcagagtagccccggcctcgaggcggtggcgtccgcgtcctctcgtccaggagccaggacaggtgtcgcgcggcgggcgctccagggaccgcgctgaggccgcggtcgccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacgggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggactgggtcatcgctccccaaggctactcggcctattactgtgagggggagtgctccttcccactggactcctgcatgaatgccaccaaccacgccatcctgcagtccctggtgcacctgatgatgccagacgcagtccccaaggcgtgctgtgcacccaccaagctgagcgccacctctgtgctctactatgacagcagcaacaatgtcatcctgcgcaagcaccgcaacatggtggtcaaggcctgcggctgccactgagtccacccgcccggcccagctgcagccacccttctcatctggatcgggcccctcagaagcaggaaaccct

SEQ ID NO: 90 - DNA, 489 bp, Homo sapiens
  misc_feature (463)..(463): n is a, c, g or t.
tggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacanatgtttgcttctttcccagtcaagag

SEQ ID NO: 91 - DNA, 1619 bp, Homo sapiens
ccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcctgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttc

SEQ ID NO: 92 - DNA, 2487 bp, Homo sapiens
ggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctccccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagccggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaacatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttatttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 93 - DNA, 496 bp, Homo sapiens
tgatgttttaacttttttattttttaaatccaggtgaacaaggactttgggtctattttttctactcttttgcctggtgctaatgctatgcttgcaccaccagagggtcaaactgttttggatggtctggagttcaaggttgccttaggaaatacctggaaagaaaacctaactgaacttagtggtggtcagaggtgaggaatcactttgctatattataaatattataattttcattcctctttattataattcatctccttaccttaaaactgtatttgtgttttaactacctttgcatgtagaatttaaggagcctaatatataagactaaacaatttggttaaaacatttgattaaaataggtgacaaaggaggaataagcaaatagaaaattagacaaaacatgtttttaaaaaatctattttcaaatattagaaaatgaatagtccaggacaagatgaaacagaaatgctgagccctatgttcaccctgg

SEQ ID NO: 94 - DNA, 1163 bp, Homo sapiens
ccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctcc

SEQ ID NO: 95 - DNA, 438 bp, Homo sapiens
  misc_feature (292)..(292): n is a, c, g or t.
  misc_feature (373)..(373): n is a, c, g or t.
  misc_feature (403)..(403): n is a, c, g or t.
tttttttttaaggcaaaagctgatcaaattcatttaatctttgttaaaagcatcacaaatgattcatcgatttttaaaaaggaaaaataagaaggaatgcattgtctctttgttatgtgcatggcagctgatggcctcgttcccaggcgcccaggtctacctgaacatcagatatgcagaccctcgaatttacaaccagggacagccacgggccacgcctgggatctccatgggtgcacagacgggaacgtatcaggctgtctcagatgccacctccttcccagggtgcttngggtccacatgcccaacatgttcttaataggaaatatttaacataaaatacaggggaacccacaggttaacttaggggggnaaaaccccaaccccaaacaggcagaggggnttttaattggggttggtcaaggggaggggccacgg

SEQ ID NO: 96 - DNA, 3753 bp, Homo sapiens
ggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaagaaaaaaaaaaa

SEQ ID NO: 97 - DNA, 1281 bp, Homo sapiens
ccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgct

SEQ ID NO: 98 - DNA, 1077 bp, Homo sapiens
tgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacggcgccgtggggaagacatgcttgctgatcagctacacgaccaacgccttccccggagagtacatccccaccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacaaaaaaaaaaaaaaaaaa

SEQ ID NO: 99 - DNA, 3166 bp, Homo sapiens
ggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 100 - DNA, 3274 bp, Homo sapiens
gcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggtccaatgcactttgttctggctcttccaggctgggagagcctttcaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtg

SEQ ID NO: 101 - DNA, 1802 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagcggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaagaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaaaaaaaaaaaaaaaaaaaaaaaaaaaaaaaaaaaa

SEQ ID NO: 102 - DNA, 1793 bp, Homo sapiens
cgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttccccctttttgtcccccaacttgagatgtatgaaggcttttggtctccctgggagtgggtggaggcagccagggcttacctgtacactgacttgagaccagttgaataaaagtgcacacctta

SEQ ID NO: 103 - DNA, 1970 bp, Homo sapiens
ggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcagttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgtt

SEQ ID NO: 104 - DNA, 581 bp, Homo sapiens
  misc_feature (97)..(97): n is a, c, g or t.
  misc_feature (318)..(318): n is a, c, g or t.
  misc_feature (485)..(485): n is a, c, g or t.
  misc_feature (517)..(517): n is a, c, g or t.
  misc_feature (563)..(563): n is a, c, g or t.
acgctgcaaacattttaatgattattgttgagcatacattttggaaattttttacttcaaacggcaacaagttaaataaatgtttataatataaaanaaaaatacaaccgaaagtaaaactcgctgtaagtgtgccttgcctttagaccaggttttccccccttaatacatctttatttttgagctgcaaacacacttaagactttgatcttcatagtatggcatttaggaaataaaaatatactcccaccttaaagaaataaaaagtttggtgcatgattatatgccaaacaaagagagaacactagaatactcttngataagtgcaggcatcattaaaaaggaaaagaaaaagcttgagatgctcattaattctctatgttttaaggaagcaggatttttgaccaagtagcttaaaagccagcaaaacagggatcagtgacagcaactggtagtgtatggagtatgaaatgacaaactttacncaaatacactgttagaaatttaccagtgaacnctgaagatctgagaagctgctccttgggaacagtccagtggggacnccctattccagtcacatt

SEQ ID NO: 105 - DNA, 2621 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 106 - DNA, 456 bp, Homo sapiens
attttttccctccactatattttggaagcacttgttcttatgtagaaattacagttatatagttagtgctgaggacaaaattattttaaacactactgatcacctaagaattctatctttgggcctgtctactatgattttagaaatttccaccaaatgatacttgctagttaaatgcaagtatctgtgattctggtaggtcaagtggtaaacttgtctttgtgacacagaatttatcattttacactaaaaaatttataagaatatttctcccatggcctataagcatacctgttaacactttttagatttaaaatatataaaatgactcttcaggcatctttttccatactttgaaaacacactagtaatggtaaaaggagtagctgttgctatcttgattctcctataatacccattccatctgatctgtatttctacccttgctgcagaggg

SEQ ID NO: 107 - DNA, 482 bp, Homo sapiens
  misc_feature (229)..(229): n is a, c, g or t.
  misc_feature (414)..(414): n is a, c, g or t.
  misc_feature (458)..(458): n is a, c, g or t.
  misc_feature (472)..(472): n is a, c, g or t.
ttttttttcattttgcaaatttaatgtaactctgataccaaaatatgacagcacacagaaagcaaacaataaagcaggaacagcaaacagatttttccatcacatgacaccctcagctgattggccataactgccttgactgctgtgtggacaaagattccaaggatgtactttggctccatgggaaggactactgcaatttattagcggtatctgtaaacatggggantaaatctgaaacctcactagccatacgagaagccacaggcaccaagactggcggctccactgccaaagccagcactggtgcttcggtccaccaccaaagccagcaccagtgtttggtccaccgccgaagccagctcctgtgctcggtccaccgttggaagccactggtgcttggtccactgcagnagccaacaccagtgtttggtccaccgttgaagccaacattagantgggtccattattnagccctgttt

SEQ ID NO: 108 - DNA, 596 bp, Homo sapiens
  misc_feature (311)..(311): n is a, c, g or t.
  misc_feature (561)..(561): n is a, c, g or t.
  misc_feature (568)..(568): n is a, c, g or t.
  misc_feature (585)..(585): n is a, c, g or t.
ccagttctttccggtcataatttaaccttctcaggcacataattccacactcggaaactgtttctgtgaaaactgtcgaccattttcagctgccctcgaaggtctttcttggtcaagtggtccagcatcctggcgtctacaaggcactccatgaagtagctgcggtactgggggaggcccaggctggggagccactcgttgccgatccactcgtggttcatgtccccataggcgagtgtcgttctagatgtgggcggggcagacgggctggtcagcgacatgatctcctggatggccagcctcagcttcancctgtgcagggggttgctgatgccaatctcacgctggatctctgtgtcggacagggccgacatgatgggcccgcttttcacgtttgctcggcaggcagccacataccaggctggcatcccaacccagagctctagccagaccacaaccgttggcccgtcccattgggcaaaaggtaaccttgtctccggggcttcctccagcaattcatgtttttttgaagtttacgaatttttttaagcctgtcccccnaatttgncaagtccaaggaatctnagatgagttat

SEQ ID NO: 109 - DNA, 386 bp, Homo sapiens
gcggccgcttgggccgcgggagcctgtcgtctccgcccgccgcagccaatccccgcgccgctcggcccgcgccgctgccgcctcccgccagcggccggggcgctgcctgaggcggcgagggcgccccaccccgccccggccccgccccgcagtagcctcgggggctccctcagcctgggtcagaggaagcgagaagaaagtctaaaaatccgaaggtttagtcgcacgcacgtttataataatagcaaaaggcgggcgtccccgcgccgcaggttgcttaggaggaggactgggtttcctgggcgttcctgggcgccggggcgctgagaagatgctacccgcggcgggcgggtgcggagagcacgaaaacgactccagtcggcccg

SEQ ID NO: 110 - DNA, 3583 bp, Homo sapiens
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttccctaaaaaaaaaaaaa

SEQ ID NO: 111 - DNA, 383 bp, Homo sapiens
  misc_feature (1)..(2): n is a, c, g or t.
  misc_feature (357)..(357): n is a, c, g or t.
nntttaaaattattaaggataattttattatcaggatattatcaggataatgatagcagaacactaaacgaaacacaagctagggccatatgtgactgcaggggtcacatgcccacaaacagctttgaactcatccccttctgggcctttctcaatcctgcccaccttcaaaatcaagtgaaaggcttctgctgggtggatgaggaagtgtccatggctctgagcctctggtctggctctgccccaggatgggccaaagtggctccctcataggcactttgtaggacttccctggaggaatggccttttatctcctattagtttataagtttcctaaggagaaaggggctacaactntcattcatcctgggaatcaccacatg

SEQ ID NO: 112 - DNA, 473 bp, Homo sapiens
tttttacagttaattctgagcatattcatttctcttctaagttgtgaagtctctgaaggcataaattagttttaatttttcctggtatcctacagtgtgcactagcatggtgccttgaacacagaagacatttaaggatttgtgggatgattcagtcctacctcaaatagatttgtgaatccctctaagccaatattgacaagcaaacagagcaagattttatgaatgcattcactgaccagtaactcaccaagatagtctactaggtgtttctttctttttgcaggacaactcttcaattacttggaaaaagtttatggctactatggtttcctcttcttcaaggaagatatgccctgtttcttcaactgtacctcaaatattttggtcctaagctcttcccacaccctggtcatggtgtaagcacaagtgtaattgtgggacatattccctttcttttgcatttagatagt

SEQ ID NO: 113 - DNA, 1533 bp, Homo sapiens
atgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcggggagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggtgcgcgccgcggggtcccgtgccccaccccggacgcgtgtgctgggcccctccctcctgcggcttgcctccccatatttcctgcgtctcttcggagtctggtccccttccccgtcttggtgtcccctgctgggcgaaacccgctctgagagtctggcagcagcgggtccgggagtctggagccttgcccatggcggacaaccgggcttcgaggttatctctgggatggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcaggtgcgggagccccgctgggtctgcccaccatcgggccagggtggacgcaggcagcagcgagccattgggggaccattgcccgaagtcaaggcttaa

SEQ ID NO: 114 - DNA, 490 bp, Homo sapiens
tttaataaagacatgggtactttattttcaaaacactcatatgttgcaaaaaacacatagaaaaataaagtttggtgggggtgctgactaaacttcaagtcacagacttttatgtgacagattggagcagggtttgttatgcatgtagagaacccaaactaatttattaaacaggatagaaacaggctgtctgggtgaaatggttctgagaaccatccaattcacctgtcagatgctgatagactagctcttcagatgtttttctaccagttcagagatgggttaatgactagttccaatggggaaaaagcaagatggattcacaaaccaagtaattttaaacaaagacactttttttttttttttgcaacacaatatacatcacagtgaaatgtgtaatccttgcaaattgcaagttgaaagaattaaattcagaggaggggagagaaagagtactcagtagggactgagcactaaatgcttattttaa

SEQ ID NO: 115 - DNA, 3248 bp, Homo sapiens
ctagaggcagctcagatagaggagctctttgggaagagacgccgggcaggcagaagcagcaggtaccccctccacatccctagggctctgtgatgtaggcagaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccg

SEQ ID NO: 116 - DNA, 1666 bp, Homo sapiens
ctccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 117 - DNA, 421 bp, Homo sapiens
tttcccaacagacatctcattttaatagtcctcatcttataaaagtgagattacagattaacatgttaaccaaagaaattactaaggtgttttgttaggataacatcacacagaatttggtctgaacaatgcaaaaggcaaatacgatgtataaaaacatatacaaaccgagcatttgttataggtactttagaattaatttctatcctcttcccgaggataacatcacacagaatttggtctaaacaatgtaaaaggcaaatacgatgtaaaaaacatacacagagtatttgttataggtactttagaattcatttctatcccctccccaataaacttgtccaattactttgttctaaattaatccttgggaacgagatcttgatagtagcttcagttcatccaacctaggacacttagc

SEQ ID NO: 118 - DNA, 1610 bp, Homo sapiens
cccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 119 - DNA, 459 bp, Homo sapiens
  misc_feature (338)..(338): n is a, c, g or t.
  misc_feature (420)..(420): n is a, c, g or t.
aaaagaaaaaagtaaggctgagcgcggtggctcatgcctgcaatcccagcactttggaagggtgaggctgaggtcaggagttcgagaccagcctggccaacacggtgaaaacctgtctctactaaaaataaaaaaagttagccagtcgtgatagcgggcgcctgtaatcccagctactcgggaggctgaggcgggagaatcgcttgaacccagaaggcggaggttgcagggagcagagattgtgccactacactccagcctgggtgacaatgaacgagactccatctcaaaaaaaaaaaaaaaagtagcaaaaaattcaaacatagaggcatatagantaaaaacacacctcagatcacacacctcttttcagaggtaacccctccaaacactctggattatataccttcagatttgttngagatgcacatgtacatacttagcatattgggtacctat

SEQ ID NO: 120 - DNA, 385 bp, Homo sapiens
cattcaatagatatttattcaatgtctgctgtaagttagactcaatgttgaggcatatttgtttatccaaagaatatctattgattgcctactatgttttaggcactgttacaggagctatggacatagtgaacaaaagagcaaagcccaagccttgtggatcttacattctagtcaagttagagaaaccaaaaatagacaaaaaattgtaaatatgtcaaggaagataaatgctctgagggaaaatcgagcagactgccagtgctggccctatttgcctcagattcattccttgcccttccagggctgggaacagggtggtgggtgcttccgcctatggtagagtgcaagtctcagcatcagttccttcatctgaagggagaca

SEQ ID NO: 121 - DNA, 762 bp, Homo sapiens
cggacctgcagccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataatt

SEQ ID NO: 122 - DNA, 4205 bp, Homo sapiens
gggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaaaaaaaaaaaaaaaaaaaaaaaaaaaaaaaaaaaaaaaaaaaaaaaaaaaaaaaaaaaaaa

SEQ ID NO: 123 - DNA, 1216 bp, Homo sapiens
ttcggcacttgggagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccagggagaaagaacttccccatacaaataaggcatgaggactatgtgaaaaataaccttgcaggagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtgggggcggggccggggggactctggtatctaattctttaatgattcctataaatctaatgacattcaataaagttgagcaaacattttactt

SEQ ID NO: 124 - DNA, 522 bp, Homo sapiens
  misc_feature (499)..(499): n is a, c, g or t.
aactcacaaaaagtattcatttttcctcatgattttaatgggcttttggtagttttaataaaacagtgttggggctctgttttatttataacatttagagcttatgttagcctattaatgtcatttatgctgaataaagtggaaatatttcatggaatgtggaataatgtaagtcatttttatatctttctaaataaaaaggattgattaaacagaaatacctataaactattcttttggaacttccgtaatgggactatcagggtgtcttgcacctagtaagtgttcaatatgtactccttgaatatgtaaatataaataaacccagaactaggccattaggtgaactagacatgaggtgaaatggagcattcgtggtgggtgccgctcttctgggagaacaatgggcagaagttcatttgtccctgtctataggacttttggtgagacaggatcacctccatgcattggcaggaagaaggaagacagagtgccccanaccagcttataagtattgtgcac

SEQ ID NO: 125 - DNA, 491 bp, Homo sapiens
ttttcacaatttcacaaatgtaatgttgagtgaaggaaaccaggcacagtaaagtacatgctggataattctgtttaggtaaagttcaaaaccaggaaaaaggaacctgtgctgttggaagagagttacctttgtcagggaagtgatgaaaagggagtccaaggagggcagctagggtgctggtaatgttttgcctcttgatctaggcattggttgcctaggtgtcttcagtttgtgaaatctcattgagttgtagagttatatatgtgtgtatttctgtaggaatatcatacttcaattttaataaaagagtaaagaatgcagcaggcagggtacatggtgtagaagagatggctgattttcactgggaaagattacccacagccctggagttcactctctgggctccctgatgtgcgtactatcccacagattgttctccaaattagaatgaatgcaggctggtttcagtattatgggggtgctctctg

SEQ ID NO: 126 - DNA, 1637 bp, Homo sapiens
gaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggtaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaa

SEQ ID NO: 127 - DNA, 473 bp, Homo sapiens
ctcactgtaataaggtaaaagtttaataaaattaaagcccttcccagtttcttattggattcactcacaggcagaaatgttcttaatgcctctcaggattccttcagcagctgcagcctggctgtctctttttggatatggatacaacacattcatttggcacttcagaagttaaattagttcaataactctatggtgtgcctcaacttacaaaaggtctggagagtcaataaaacacccaaggtaattacaatacttgccttatacccaccaaatttaaaaggcagttatcctgtacaaaattatgctcccaaaactcagtagtatttattgccaaagactacatgtagcagaaactctatagcaggaactcatgaatcagtaggaaggaagataaccggtgatggctttagcttaatcagaatgccagtcacatgagctggcacacttaaactaagttgggaagaaatttg

SEQ ID NO: 128 - DNA, 7250 bp, Homo sapiens
ccttggccgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaatcatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctaatccttcctttgctaaatctcacctttaaaaacgaaggtgactcactttgctttttcagtccattaaaaaaacattttattttgcaaccattctacttgtgaaatcacgctgaccctagcctgtctctggctaaccacacaggccattcccctctcccagcaccttgcagacttgggcccatcaagagctactgctggccctggctccgcagcctggatacttacctggccctcctccctagggagcaagtgccttccacttacttcccatccaggtctcagaggtctcaaggccaaccttggaatccttatttaaccattcaagtaatcaacggaagttttcaccctttaatcttaagtttagccttttaagaaaaacagtaagcgatgactgctgaaaggctcattgtgtaatctcccaagggtttggtcttattccattttcttctggtcaccagatgatttcttcctttaccatcaaatacttcttcataatggtcacagtctgaggatgtgcgcaaattctggttcttcccaagctctaaccgtaacacgtcccaccccctttttaaagcacttactgttttcagagcacccatatcccaccctggtgagaaggccactctcacatctgagtgttgggtacaaagctgctccgtagagtgatgtgcactcctggtgggtgaggggcaggggcagtggcagtgtgcaaagaattgattactccttgcagagcctgtggcttgcatttcctactgctttctacgtttgaaaattatgacagtctctggctaggtctgggtccagattaggatttaaactgataaaggaaactgttggtaaatcctctgctcagaaagcatttatcatgttcctatttaaggattaggtttattaatttaggcctcttagaagctaacccacttaaatattactcttctgaatgctagttctcttttattcttgatgtcctaagtcaattgaatctggcatctggggctagggtctgcctgtctacatattttttatttttttctgagaaattctgaacacatagatctctttcctaaactgacattttctattttgactgttttcatactataaccaggtaaagggacttctttcagagagctttatactgcctgaccaaagaacaaatctgaaaatcaccattttaaagttattttttcagttgaaccaaagtttaagtgaagaggacttttggcatattatacccaggatcagtttgtctttttgtatccatcaagtattacaggagaaggattgggaacagaatggaaaaacagtgtatgaaagtcatgttacaggccgagtgcggtggctcacacctgtaatcctagcactttgggaggctgaggcaggtggctcacttgaggtcaggaattcaagaccagcctggccaacatggtgaaaccccgtctctactaaaaagacaaaaaattagctgggcgtggtggcgggcacctataatcccacctacttggtaggctgaggcaggagaatcgcttgaacccaggaggcggaggttgcagtgagacgagattgtgccactgcactctagcctgggtgacagagcaaaactgtgtctcaaaaaaaaaagtcatgttacacatttaagtttttgaaattgctccttttatcggtaaagattctcaatccaaattctcctgggtgtgttgtcatcagctgtgatatgtttgtgcacattacgtatagcagaggatgtaagcaatattattgtttgtgaagttttgtttttaatgtcttgagtatgagttatgtttagtcactgtcagcatctgagaactttaataagcccttgagatattccaaagttttattttacttttttaaagaacagaaaaagatgaatgaaagaaccaaggagagatgcagagactatatttagcatgtataggttaaagtaagaaggaggttgtggtaactaaataggagtcctataaaatcaaatacattgtcaaccttttctgcacatctagtttcctaccatagaatcccactggaataccacatagcttttgcactgcagttactatttactaatgtaaacgtagggtttgtaaaagtcacaaacttataagcaatgaacttacctgctagtctttttattttggcttgcatgaagtcactgcaaattcaaatgtcagtaccggcatttaaaatatatctatatcactttgttggtacaaagttatttcaagataagtgtaattttgttacaagtttattttgaagagacaaatctcctgtgatctatgcaggacctctgtactttctaaagaacaaaatgttatgtagacattatacatggttggttgtctcttcttgaaactgtaatgtaaatctagggtccagtcatatcctaggtatcatcatttatccaagtacttggaggaatacaagtatatataaatacagtcattgagaataagtcgatttgaggcatacaagagtagtttcttacacagtttaacacggcctgattcaagactctgataggattcaaacagataccggttaaccatgactaccaaaactgatcatctgagtcgattgatagaggtgtgactagtccttagcactttttctcattcctctttttattcagcattgctgttacctatttcaggtttataagacctctttcagcagatcacatcagaagccaggaaatgcatagctaggagatgtcaaaagcccatatgaggagtggaccaagcagcagtggcggtttctcctcgcatctttttttttttaagctttaacttagcaggggcatggactttatagcactttttcaactttttgctttgctttggataagaaatccttacctttaaaaaaagcttctagtctccataacccccaaagtactgcttatttgtttgaagaatccagccatcgtagtgctttagtcactatcgtaaacattcatgatagggcaaggattttaaaacaggattcttgcttctgtagtcatcaaggtgaacagaagcatcctacacaaccactaagggctctatgtttgtgtcatgcctcttcaaacaccaaggagttgaacatgcttccagtgatttgtctccgtaatgccttcttcctttatttggcctttctttctttctgtaccttcaagttcttgatttttaaaattccaactctagagaaaaccaatatatggtggtgctgggctttgaagatagcatatcagacgccttggttctgtttgtacacttagccttacatttcaggaggaggcttttcattaggggcttaagctagctcctttggcttttaaaaaaaattttttttcaaatttcttcattacctaagggagcctgcatctaaatttctcaactagttcagcctagctgaattttctagtgtgtaatacactttgcttccttcttattggtgaaaaccagggggatgagtggcttccatggagagatttcctgatttctcagggaggaaaaaagtgatgacatttaccactacttttatgtttttcccctttttccaaattgataaggatttctggttcctagtgatccgggattgggcaacagtgcagaactgccagtcatgccgtaggccgtgaagaaagaatgtgagtaactgttgttttgcaaggatttgtagggttatgggcagttgttgtttgaagcattgctatgacctaattcccaaggtatctttcctctcttggtgttctaggtaagccaatgagctttaatctctacttgctataaccgtgtgcttagaaaaagaggtgagagtagtggttttccttcaaactgtccacattcatgaagattatgaattgttaggacagccagggcaagatagaccctgtctctacaaaaatttttttctaaattaaccgggcatggtggtgcctgcctgtagtcccacctgtgtgggagaatcacttgagcctgggaggtcaaggctgcagtgagccatgattgcacccctgcactccagcctgggtgacagagtgagaccctggctcaataagagggggaaaaaaaattgttaggagctgggtgcggatgcagcctgcaatcccagctacttgagaggctgaggccggaggattgcttaaacccaagaatttgagcgtagcctgggcaacacagcaagaccccatctaagaaaaaaatgttttttaaatcagcttagcccaaaggggttgtgaatggggaggtataaaaagcaaagattattttttggctactaagccaagaacttacagggattttttttttcagtcccagaacctacagataccctgctacttgcttcacgtggatgctcagtgcccagcagccatcttaatacattaaaccagtttaaaaaataccttccatgtggagaaaaacatgtctttttctcgcctcaactttatccacatgaaatgtgtgcccatggctgggcgcagtggctcacctgtaatcccaacactttgggaggctgaagcaggcagattgcttgaggccaggagttcgagaacagtctggccaacatggcgaaacctcatctctactaaaattacaaaaattagccgggcatggtggcacatgcctgtaatcccagctacgtcaggaggctgaggcacaggaattgcttgaacccaagaggcagaggatgcaatgagccaagatcacaccactgcactccagccttggcgacagagggagactctgtctcaaaaaaaaaaaaaaaaggtgtgcccaggcccctagccattgccatgtgcccagccagagagccaaattagagggctggcttccctatcacacagaataaatgctagtgctagccaatgatccctttgcttttaatgtatagaaaatactgttgttccttttgtcatttccagtgacatctgttttctaagcagctcttttctagggaggaaaccaaaggggctaggttaagaccctaatagaaatgttttttctaatctctggtgagtctggaagtgtcacattcacagtccacccttgggagtggcttggtggagctggggacaaggttttgtttactacatagtgcacatgataaatggccttaaactgtgattctttctggtaggataagttataataaactgaccctaaagaatgcaaaaaaaaaaaaaaaaaa

SEQ ID NO: 129 - DNA, 2100 bp, Homo sapiens
gcggaagtggcggcggcgccggcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 130 - DNA, 1542 bp, Homo sapiens
ctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaa

SEQ ID NO: 131 - DNA, 3091 bp, Homo sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttct

SEQ ID NO: 132 - DNA, 469 bp, Homo sapiens
  misc_feature (62)..(62): n is a, c, g or t.
  misc_feature (224)..(224): n is a, c, g or t.
  misc_feature (226)..(226): n is a, c, g or t.
  misc_feature (254)..(254): n is a, c, g or t.
  misc_feature (438)..(438): n is a, c, g or t.
  misc_feature (464)..(464): n is a, c, g or t.
gggatgggaaaactttattaggtttggtttccagcttcggccacgcgggctccccacacagnagctcgggtcacggggcgcccccgccgccctcctcgtcgtcctccacgtcgaggcccgggatgccgcggatctggcgttgcagcgccctcccagcaagggcacggcgccctcctcctcctcctctgggggcggcggcggtggcggcgacacggccccggggntnggctctgggggcacgggaggctgcgcgncacgccctctgcgccctccgagatccctgccgcttcgccctgcgccccctcgtccagggcaccgccttcaagcctcctcctagctccttctcctcctcggggcttgtccggtgaaaagggttctcgccctttcaagtaagcgctccaagtttctttgctgaagaagttgttgtttgaaaaaaantggggggcaacaattaagggaagaanttctt

SEQ ID NO: 133 - DNA, 2492 bp, Homo sapiens
gcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaaaaaaaaaaaaaaaaaaaaaaaaaa

SEQ ID NO: 134 - DNA, 368 bp, Homo sapiens
caggccgggcgagcgggagtctgacgcgatttgctgagctctgtcctccgacggctgcctcgcggccttgagggcctccgccgcctgttcgctgctgctccctcgagcggagcctgcgtcaggttccctctgcatccccctgcggggggacccctgctccggaggagggggccggagagccgcggcggcggcggcggcaggcgcctgggcccagggggccgggcgccgggcccgaggagcggcggaggccggggcggcgccgccgccacggtcgcggacgagtgcggcgccggtgagcggtgcccagaggcagcggcggcagatctatccatactaatggaaatgtaactggaactgactctgatgat

SEQ ID NO: 135 - DNA, 4489 bp, Homo sapiens
agcttcgccagctgagcaaggcgaaagccaaggcgcagagggccgggcagcggcgcgaagaggccgcgctgtgccaccagctgggggagctcctggccggccatggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactgcgggagctcagtgtagctgaagatgaagatgaggaggaggaggcggaggaggcggcagccacagcggagagcgaagccctggaggccggcgaggtggagctctcagagggcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggccggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaaaaaaaaaaaaaaaaaaaa

SEQ ID NO: 136 - DNA, 2896 bp, Homo sapiens
cccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctccccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggcttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactcctgcgggcgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagccctgccctcaccctcagactaggcagaggtgaggctggctcaccctgaagaggtgggataggaggggactgcacccatactgcttccctaccacaaatcagggctcagggagaggccatgcggcagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccagctccaggcatgccgctgcttgtatggctttctttggcctctgaccctgctgcccattctttccaacatcacagatgaactgcctctcctcctccctgcctggggagcccagtggccagggagggagtggtggagccagtcgctgtaacactgagcctcagagacgaaccaaaaccagctgggctgagctcagatccagggggaagaaatgctggaagtcaataaaactgagtttgagaaaaaaaaaaaaaaaa

SEQ ID NO: 137 - DNA, 2269 bp, Homo sapiens
cagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtctatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttcattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagtaaaaaaaaaaaaaaaaaaaaaaaaaaaaaa

SEQ ID NO: 138 - DNA, 170 bp, Homo sapiens
gcggccgccgcgtacgctggacgagctgcccgagccgctgctgctgcgcgtgctggccgcactgccggcgccgagctggtgcaggcctgcgcctggtgtgcctgcgctggaaggagctggtggacggcgccccgctgtggctgctcaagtgccagcaggaggggctggtg

SEQ ID NO: 139 - DNA, 291 bp, Homo sapiens
  misc_feature (183)..(183): n is a, c, g or t.
  misc_feature (189)..(189): n is a, c, g or t.
  misc_feature (227)..(227): n is a, c, g or t.
  misc_feature (235)..(235): n is a, c, g or t.
  misc_feature (248)..(248): n is a, c, g or t.
  misc_feature (259)..(259): n is a, c, g or t.
  misc_feature (270)..(270): n is a, c, g or t.
gataatttttaaaactttataatggcacttgaaaattcaattaaaacaattgcatcatccaggaattatacaatattgcattgtctctcatttcatgtgatttatgattctaagatgcccattatgttaatatcttccaaaccaaagattattttcccaacaagtgaatggtgtaattttacntaatanatttagatagatcacaaagttctataaaacattgtacnaaagtacnaaaaaaaagtgcnttatgcacacntttttaaaacnggccttggcccctttttggga

SEQ ID NO: 140 - DNA, 2722 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggaggaagacacagcaccctggagatgttaaggcagaagtcagttcttctgtccatccctctccccagccaggatagagctatcttttccatctcatcctcagaagagactcagaagaaagatgacagccctcagaatgcacgttatgaggaaggcagaatgtgggtctgtaattcctccgtgtcccttctccccctctgcaaaccgtcgtaacaataatagttcctaacacatgggacaattgtgaggattaaatgagttagcctgcagaaatcacttgatgcacagcacatgggaagcattgtgtgtatttattaatccttcacaaagtctttgagatatatttttatcaaatatttagcatggatcccggtacactttcaatacttaataaatggtcaatgttattctttttcactatt

SEQ ID NO: 141 - DNA, 1679 bp, Homo sapiens
gtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatg

SEQ ID NO: 142 - DNA, 252 bp, Homo sapiens
cattgacaatgtttattatcaagaaactttaggttttttaaaagaatgctcgttttagaatacaccaagaggacactctgtgacaggacatatacaaacaaggataattaaaatattaaatactatctaaattaaaagaccataattcaaattgctaattataatatttgtgtcggtagaaataactatagttccccttcatgaaattcacccccacgttctcatgaagactatgacgtctcaccacaattt

SEQ ID NO: 143 - DNA, 4333 bp, Homo sapiens
gccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 144 - DNA, 556 bp, Homo sapiens
  misc_feature (64)..(64): n is a, c, g or t.
  misc_feature (66)..(67): n is a, c, g or t.
ttttcgccatgcccatcagggtttattgtttctgtaacagcggccaccgcctggggcgtgcgtngnntgcagctggagatctctcagcaccttgggttgggggcggggctgggcgggacatgggatggaggcggtgctgctggcagacagggtggaccttggggcctgcaggcaggagatgagttcggcggccacagtggcccccagcagcagcagcagcagcgggaggttcagcgggcgcgctcaccgcaccaggtggaaggtgagccagtacatgagcataggctgcgcgccgccaccgccatggtcaggtacatgcgcactggttccgggccccacgcaccgggaccccctcagctgctgcgtctgccaagatcttcagccgcagcgtccggatcatgaacacaaagatggctacgcagcaccagcccagcaccaggtagtagccaatcttcccgaagagcaggcccatgaggaccccgccaatcatcccgacatatttgtagcccaagaaggccaccaggtcgatggtggtgaggtcggtgttgacagtgac

SEQ ID NO: 145 - DNA, 2859 bp, Homo sapiens
gtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcacgtaccacaggccatcaagcctgtcacctacactgtggccaccccagtgaccacctcgacctcccagccacccgtcgtgcagacgtttcacgtcgtccaccagatcccagcggtgtcggtcaccagtgtggccggactggcccagcgaacacgtacactgtctctggacaagctgtggtcaccccggcagccgtgctggcccctcctaaggcagaggccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagtgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacagactgcgaccgcgattgcagggaggagcatctgaggtggtcacggggtttgcccagctcacaccaactgcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcctgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctc

SEQ ID NO: 146 - DNA, 384 bp, Homo sapiens
  misc_feature (24)..(24): n is a, c, g or t.
  misc_feature (41)..(41): n is a, c, g or t.
  misc_feature (45)..(45): n is a, c, g or t.
  misc_feature (51)..(51): n is a, c, g or t.
  misc_feature (87)..(87): n is a, c, g or t.
  misc_feature (353)..(353): n is a, c, g or t.
  misc_feature (358)..(358): n is a, c, g or t.
gtttgtgcgcggccagggctgggngcctccgctgcccggancaanccagancttccagctgcctctcatgtacttgtctgttggggntttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactggaagattcttgccatgttaaatgtccagctttgagtgggacttccagctggaggangttcngagaaggaaaggactttaattgattt

SEQ ID NO: 147 - DNA, 337 bp, Homo sapiens
acggaattaaaaaacaatttttatttttagttatggttacatttgcaattgtaagtggtaatcatttttactttagatattctggaaaatacatacaattaaagaagaaacatgaatcactcatgtaccttccattcttagaataatcagtgttaagactgtctgcagaaagtatccagtacaaagtagtggctgagcccactggtgatacagaatgtatcaggcactgtgattcttggatctctggccaaatgtagaatcatttactgagctaaaggccaatttgcttggaagagtgcatctaattaaagtgagattagaaaggacgaaaggtgtc

SEQ ID NO: 148 - DNA, 565 bp, Homo sapiens
  misc_feature (462)..(462): n is a, c, g or t.
  misc_feature (562)..(562): n is a, c, g or t.
ttttacacgtctaacattccctttattgcttacgtcacatattccaatgaatacaataaactcctttttaaaaaagtaaggcacatgaaaagccttttgtgtaagttccatgttattttaaaattcctattggctaataaaagcatttgcactatagagccagagacatctagaaaagcacatgatagatttttttgcaagcagaatgcctgaaacattacatttacctcatggcacaatgagacagtcaccaaatccaatgtctgcattagaacgatacagctactattacagttgcaaaaccattaatcagcttatccacatatgtacagctgggtccccacgtgacaaaatctaaaggaagaacagcatctaactgcacctgtgctccattccctcacagataggaactgtgacattttggctctttccatgttgtgctgctcttcacgagaggccagngtcatacgatactgaagaccatggacaggtactggtcgtacgacacctgaatccagccgtcctgatccgtgtcgtaacgtctgaatatatccgcaacctnctg

SEQ ID NO: 149 - DNA, 6699 bp, Homo sapiens
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccaaccgcctgcccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgcagtcgatagtgtgcactctttctctctctctctctctctcacacacacacacacacacacacacacacacacagagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagtggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaatgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacatt

SEQ ID NO: 150 - DNA, 774 bp, Homo sapiens
agtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcat

SEQ ID NO: 151 - DNA, 2931 bp, Homo sapiens
tgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtataaaaaaaaaaaaaaaaaa

SEQ ID NO: 152 - DNA, 483 bp, Homo sapiens
tttttttttctgttcccttgctctggttttcttcacagactcttgtccaaaggttgactcactttttaaatttttttcatcttctatttttcttaacatattatccgttgtttatgttcctcctactttagtctccatttctgaaataattttcttttatttctaattcttttcctgagcttcatttcttagttttactaatgctgatcgtttttctttcatgtcttataccatcttattgtttttagctcattttgaaatacaaggttacaattttcgacttgtcttataggtgtatatttctggcttgatttcatcgtctctagggatgctgttcttttccgcatcccgtttttcttgtaacactgtacgggatttgaccttgttattcctgttattgtttttatgtgaaattagttttcctcaacttttagaatgaggtgaattagggtagtttttctaacttcacagagctcccctcct

SEQ ID NO: 153 - DNA, 1723 bp, Homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgg

SEQ ID NO: 154 - DNA, 466 bp, Homo sapiens
  misc_feature (378)..(378): n is a, c, g or t.
ttttttttttttgtgagctaaggatttaatcactgtcaagcagatcttgagggttatagttaagcctgataacagcctctttaacaagaacacacacatccaggatcccctcaaagaatccagagtcctcaggctccccacaaaatgtagtctggcagaaaagggaagtctttagagtctgcagaatgatgcaaacccaggccagagtggaccacactgctctcggcaccactcctaaaggcatccattggcaacggctgcccactaggggcactgccacttgcctggctcaaacttcaggacctggggaagaaatggtctggctctgcggccttcaaaccatctgggatctctggctcctcagctattccttgaagnttttccatgatgccccctgaaaggtggctcagggactggggggaggttccctggggctttcagacagcacatagttagacaatttttt

SEQ ID NO: 155 - DNA, 436 bp, Homo sapiens
ttttttttttccagctataaccttttgtttattaaagaattgatgaaaataaaaacaacgtatctcacagcatgtgtgataatatttccatacgtatgtgataatggatcaacgtttcctagagatgaaataaaaagttctaatttggacaaaagcaaacaaggaaaattataccgtagaaaagcccggctgacggaagtgaggccctgtctcagggagaaacatcggagacgtttaaaagcagggagtgaaacagaggatagcgtgccatttttaatactggcccttgtttcagtgggaaaaggccaaaataagccgtgcatatcctggattctcgcatcgatcgttcaggatcggagatgtgttctccatttccagttacgcattgtatggtggaattgcagttagcacatttggtgccaaaattgtaatgctg

SEQ ID NO: 156 - DNA, 3364 bp, Homo sapiens
agcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccatgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcagg

SEQ ID NO: 157 - DNA, 4266 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatactgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttcctttttatctctcaagccaccagctgccagccaccacgagccagctgccagcctagctttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattctacggggaattcttaaaactgtgctcaactattaaaatgaatgagctttc

SEQ ID NO: 158 - DNA, 417 bp, Homo sapiens
tttttttttagacgggctaaggtttatttacttacttaacatttaaaaataattcatttgcttcaacaacatggcagacaatcaagagtactattgaaacataattcagagagggtcaggacaggaaagatcacaacctcattcctgaggtggaatgaaagatctaagccaggcctccatcctaggccaggctcctccattaagcagagacaaccaaaagataagaaagccttggcctcatccccatcaggagatagcctgaactgctcacaaataagaaacaacttgaccagactgaggactggttcctgatgagtcaataggaaagtcagttggttctctcttcagtaggtgacttagcacccttctggagaacatagagtagtagtctggacctggaggctaagggccacatcc

SEQ ID NO: 159 - DNA, 6696 bp, Homo sapiens
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccagccgcctccccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgtgctgcaacagccagtcccacaaggggccccgagggcacccccaaggctacacccaccacaagtagaccttcgctgtcatctgacgcccccatcacatctgccccactcaagatgctggcccccagtgggtccccaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggccggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacacacagagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagtggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaatgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacac

SEQ ID NO: 160 - DNA, 385 bp, Homo sapiens
tataacatttatccatctatgctgcagaaaaactcgggaagcacaaagaaaaaaattaaaatcacccatcatcttgcctccagagagccagacatacacacacacgtatgtgtatgtaatgttggatagaaactgtgatggttatcctatgcattgttttagaaaataaaaaggaggtgatacatggtacagaggcagaggtgcctagtggttaccactcactctgtgaacttgggaaaacacgcatgtagtttttgaggatgaaatctatgaacatatgtgtctggcacatcgtttatgctcagtaactattacccagcatttttattaaacactttccagtgtctctatgttagtctgttttgtactgctatgaagaaatacc

SEQ ID NO: 161 - DNA, 422 bp, Homo sapiens
  misc_feature (366)..(366): n is a, c, g or t.
  misc_feature (395)..(395): n is a, c, g or t.
cagtgtgtaccttattagtcccatataactttgtttcagataatccctattaatgatacagttaaacatacattttaataatctgtgaaaacattaatgcaatattttctaaacttttcattaactactatgtattaataaattggcatcgttggttaacagggttctgaggtcagataggtttatggtatggtgcatacttatatctcttcttagagatttataatgtacattataatgtcaaagactcagagttgctgaagtaaataattatgttcagtccaggagtttctttaggtgccaaggatggaacaaagtgacaaagatgtctattccttttagtgcttttggtattttgggagggcntgttttggtacaactaaaataaaaggccntataaaaattagcccactccaaatggt

SEQ ID NO: 162 - DNA, 3958 bp, Homo sapiens
gtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggaaaaaaaaaaaaaaaaaaa

SEQ ID NO: 163 - DNA, 538 bp, Homo sapiens
gctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaat

SEQ ID NO: 164 - DNA, 1421 bp, Homo sapiens
acttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcatggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcaagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaatt

SEQ ID NO: 165 - DNA, 465 bp, Homo sapiens
tgaattccttattccagacattttatttattttttcttgtaggcgtgtggtcttgctatgttgcccaggctggtttcaaactcctggcctcaagtgatcctccggctttggcctcccaaagcgctgggattgcaggtgcgtgctaccgcatcctgctggcagtcgtttcaaagcacatgttttagctctcggcaggtggcctggaaggacccgaccccagcccctgtgctccatgcaccatgccaagtgcccccatggccccacttacctgctctccccagccctccagggaggcagagcaaaggcaacagaggggtcgcctgtcacctctatatgcgagtggccttcacacccagggtggtcagtgcagcggccacggcttggaatgaggcccatgactttggcccacccgcagccctgccgacctggctaaatctgcaaatctggcaggagtggcccttgcag

SEQ ID NO: 166 - DNA, 927 bp, Homo sapiens
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagccaaaaaaaaaaaaaaaaaa

SEQ ID NO: 167 - DNA, 396 bp, Homo sapiens
  misc_feature (18)..(18): n is a, c, g or t.
  misc_feature (21)..(22): n is a, c, g or t.
  misc_feature (358)..(358): n is a, c, g or t.
ttttttttgagacggagntgnntctgtcacccaggctgtacccaggctttcttgtgcgagcaccacaccaagggcaggttgggcttgaaggagcccttgaggaaacacgggttctccgaggggtacaccagcagggccttcagcttaaagtcgccggctgcgttgccaccgagcaatagggtcaggaggtctccggcggctttgacccaggggccgactcatcttccacaggaaaatgaacgtcctctcggcaggcgcttacagaggaacctgggcttattcatggtgaacaccagccagagcttattcatggtgaacaccagccagagtgtgtagccgccctccggattcaccctgngcattaacgctgggttcttgcacgctgcgttcttgggc

SEQ ID NO: 168 - DNA, 546 bp, Homo sapiens
acggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatct

SEQ ID NO: 169 - DNA, 692 bp, Homo sapiens
cctagtacaccgcaatcatgtctattatgtcctataacggaggggccgtcatggccatgaaggggaagaactgtgtggccatcgctgcagacaggcgcttcgggatccaggcccagttggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttc

SEQ ID NO: 170 - DNA, 426 bp, Homo sapiens
  misc_feature (232)..(232): n is a, c, g or t.
  misc_feature (405)..(405): n is a, c, g or t.
ttttttttttttaacagttaagatttttgtttaaatttattttttgaactggtaataattttacatgtttcaaaattccaaaaatataaaatgataaagagtgaaaattattcctcatcactgtcctcccaattcttctggccaaccagtatgccacttttaccctttcagagattatgtgtgtacatataaacaaatgtttcttatttatttatttatttttgaggatggngtttcgctcttgttgcccaagctgggagtgcaatgggcacaatattgggctcactggcaacctccacttccgggggttcaagcgattctcctgccttaggcctacggggtaggctgggggattaggaaggtgtggcaccaccacacccagcttttggtatttttagtaggagntggggggttttcaccgtgttg

SEQ ID NO: 171 - DNA, 4255 bp, Homo sapiens
gaggcaatcgtccggtgtgtgagcccgggagccggaggtgtagcggcagagacattgttcttgccggctccctacggtgccgtgtgtgcgtgagagaagaccagtctttcctctagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcatttaaaaaaaaaaaaaaaaaaaaa

SEQ ID NO: 172 - DNA, 445 bp, Homo sapiens
  misc_feature (2)..(3): n is a, c, g or t.
  misc_feature (19)..(19): n is a, c, g or t.
  misc_feature (24)..(24): n is a, c, g or t.
  misc_feature (50)..(50): n is a, c, g or t.
  misc_feature (210)..(210): n is a, c, g or t.
  misc_feature (224)..(224): n is a, c, g or t.
  misc_feature (285)..(285): n is a, c, g or t.
gnnctgcatagggttcggngtggnagggtactgtggtacggagcttggcnggtaccagtgtggattcaagtgatcatcacaggtacatatagtgatcttccttgtccgtctcgtcccactgggtaccaggcgaatcctactgggtaggtcgggtacgcggcatatgtggggtatgtttggtatccaggtatttgaggtacgaattcagtntacgttgccaggtntgcttggtcttctaaatttggaatagataggcgaggatactgattctggatagtaaaattntttggagctcggcaatcataagaaacttgcagtttccaccccctcttcacctgggagaactttgggctccattagggtgcaatcgttggagtaattagcccatcttttacatttctttgccacaaaatctcgaagacttgcccatttcaaggttccggac

SEQ ID NO: 173 - DNA, 358 bp, Homo sapiens
  misc_feature (4)..(4): n is a, c, g or t.
  misc_feature (6)..(6): n is a, c, g or t.
  misc_feature (338)..(338): n is a, c, g or t.
taantnatttccctaggtccagcccctagaaccaccacacagattccacccagaacaaaatgctctacaaataagaaatgctattgcttacattattttatgagaaagcactgacatatcctgaggatatatccaagacatttcaccgtcttttaacagaaaacataattcagtttgaatgttagatctgcgtctagaattctgtttaaaatgaacattaaagcaaaaatcccaccatcctattgtactcaggaatgaaccaatctccacaaaccatgaaatagttaagggctgattcattcacaactaattcaggtaaacttaatggaaaggcgggncaggaatgtggggtttgaag

SEQ ID NO: 174 - DNA, 2795 bp, Homo sapiens
gccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacc

SEQ ID NO: 175 - DNA, 462 bp, Homo sapiens
aaaattgtaagtaaacagatgtctttattctagagtaacatagcacatttgttatctcaccaaaaatagattcttttctgatgttgtagagtagagaatctgaaaccaacagtgtacgtgtaggagcttcaatccattcaactggtggcatcatatacttcacatccttaggactgcttatgtgatgtgcagtcaaggattgggcaggtcatatatcatgtcactccatccttcaatgccttttgatctgtttagcagctccttgtgacaaccttcagttctgcccagactccttcctgtggatggggagagttgctgacacaggaggcagagtagaaacgcagcagcttgtgctctgccctcctccttctccgggacaccctgcctcctctctccaggcctccatgggctccttggcctctgaattcctgtagacatgtgattaggatgcgtgggaggcgc

SEQ ID NO: 176 - DNA, 467 bp, Homo sapiens
aattggttcaatcatttatttattagagtgagtgcaatacagttcctgcccgcatggggggaaacaggctgggaggagggccaggggcaagtaagtgctaggaggggaaatgggagggggctgggcgggcactgtggggaggggcaggggttcccaaggcaacgtcgaaatctccaaatacagtgggcctgacggggatgacagagaggctgaagagacagagccgtcctgcacagtccaggcaccaccctgccctgccactgcctggcgggcatcttgagctccagacccttagcctctccgggccccccagttttttccgggtaagagactcgaactgatgctctctaaggattcttcaagctctgaaattctctgctgacatttgccagcagcaaggttgactcgaatctgaaacctctggggaaagtgggggcctctcccagaatggaaccctctctgaacac

SEQ ID NO: 177 - DNA, 3026 bp, Homo sapiens
tcgacccacgcgtccggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaaaaaaaaaaaaaaaaaaaa

SEQ ID NO: 178 - DNA, 2070 bp, Homo sapiens
gccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggca

SEQ ID NO: 179 - DNA, 2488 bp, Homo sapiens
cggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctacaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccg

SEQ ID NO: 180 - DNA, 438 bp, Homo sapiens
tttttttttatctgtcccattaatgatgctgttcttcagggtttggtcttaatcactaatcttttctagggatcacaaactagcctgacaaagttcagggatagctttcttttccagggctaacagtgttggaaataactgatgtgaatgtctttaagtaagacagacagacactttactactccctgttgtctgccatttatattacctaccaggctcctaaaataagttcatgaccccaactttacactccctgattttgtgtcatgtgctgggtttatagtagagaacaaaaataaacatgttctttgaactaactaagctttcagacaaatgggggaaacacagttgaagacatttttaaaataatgttacgcttagggcacagtgatagtttaacaacaatactgcttaaagctcaaacaaatcttttaccat

SEQ ID NO: 181 - DNA, 2428 bp, Homo sapiens
gggagcgcggcgcggccgccgcgtgcgcgagccggggttgcagcccagccgggactttccagccggcggcagccgcggcggccgccggctcttccccgccccccgtcatggggcagcccggggagcagaacgctgcggaccgcggcggaggacgcgcccggcgcccctgagccggccgagcggcgacggaccgcgagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctc

SEQ ID NO: 182 - DNA, 5288 bp, Homo sapiens
ggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgtgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgc

SEQ ID NO: 183 - DNA, 2828 bp, Homo sapiens
acattgggctcctcctcctcgggcccacgtgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacaggtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtga

SEQ ID NO: 184 - DNA, 428 bp, Homo sapiens
  misc_feature (419)..(419): n is a, c, g or t.
attcttgttggatgcagtagtgtccttcatttcttctctgggtgtgtgcagtttccccatatacattaaagcacccgaaaacagggccctctagcttttcgttcttttgtatgtcccccaaggcattaaaaaagtagagattggctttacacatcccaccccaaggctttattcttaagtgtgaaactcactgtctgacagcttcagggatgtggacttgatccagggatatgagttgggccagctcccccaggctgtccagaaaacggatttttcgtgtgaatttggaactgaaaagagagaataaatcaactgtgttttgtattgggagaagggttcccaaaaatccttgcaaagaaaaatgtagaagtagagtggttaaggctagaaagaatcaaggtggagaaagatcttaatcntgattttga

SEQ ID NO: 185 - DNA, 453 bp, Homo sapiens
  misc_feature (50)..(50): n is a, c, g or t.
  misc_feature (451)..(451): n is a, c, g or t.
ggggttggggacaaaaggccgggcgggggctgggggtctcagggaggggncgggcgtgtgcggccggggcgggcttacgcggaggacaaacagctggcgagtgtcagggtctggccgcctccccgctgcccacacgcacctacccgcgcccgggacgcgcattttccttctctcgccacgagttcacctgggactttgcaaataactgtgcggtgggagctgcgctcaagccttgtcatttgctgagggtgggtggcggtgccaaggaagtgaacttattttgttccttcacaaagactggaccaggcggtgcctttcacgcgaagaggttacgaccacggacacaacctcctttgatgcattgtgcgaggcagcacctcgggccccggacagtaagtcatttcacagaaaatgcaccgccccgagtgtcttattgctgtgatgaaatggnaa

SEQ ID NO: 186 - DNA, 249 bp, Homo sapiens
  misc_feature (229)..(229): n is a, c, g or t.
  misc_feature (243)..(243): n is a, c, g or t.
ctgttttaaagaaggcgaactggggaagaagagagctccctgcttctagtgagcaaaggcagcccctgagcttccacagccctccacatttattgggtaggatgaaagggaggaggaggtaacgactggtcagctgcttaattgatcacaagttcacattattgttaacaggcttcaattatgcctaatcacaagaaacacttgtgcctgggtcgtgactgccttcagnattccttctgggtnggaaaa

SEQ ID NO: 187 - DNA, 691 bp, Homo sapiens
cccgcgcaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttaaaa

SEQ ID NO: 188 - DNA, 2462 bp, Homo sapiens
gcccctcatcccaggcagagagcaacccagctctttccccagacactgagagctggtggtgcctgctgtcccagggagagttgcatcgccctccacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacat

SEQ ID NO: 189 - DNA, 440 bp, Homo sapiens
  misc_feature (146)..(146): n is a, c, g or t.
  misc_feature (262)..(262): n is a, c, g or t.
tacatcaacaacaaaaaggcattttattttattatttttattttttttgagacggtgtttcatttttgtctcgggtctttttgtcttatccggtgcaggggaaacactggttttaggaaacatctcagattgctgttgcctggtgncggccccttggacccccacattctgctgtggtctgtgggacttcaggttacttggggctaaagtgctagagtctatccctgaagtcagaggggccttgctggcccacggagcgtcntgcttccccttcgcagatggcagggatttggactgcgccgggaaagcagacttgggcttcgggtttacagaaactagagaggggaggcacatcttttcccagcaacgctgcgggggcatccggtacgtcgacttctaagcaaggacttgtttcgacagtttttatgaacgtcaggatt

SEQ ID NO: 190 - DNA, 5705 bp, Homo sapiens
gtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacgtgaatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtaaacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatattttta

SEQ ID NO: 191 - DNA, 399 bp, Homo sapiens
  misc_feature (172)..(172): n is a, c, g or t.
  misc_feature (288)..(288): n is a, c, g or t.
acagggacagaatttttattaaaaagcatgggcacactgctattttcagaagaggtagatgaaacaattttctcagataaatgtgacacaggtatgttttcatcagaactatgcacagataagtcagtggcagtttctggaagtttacttgggttaagagactgctgtagtnacagtggtggtctcccggaggtgggcagacttgttgctaggagatctacagtttggattgacaataatgacaccagtcgaaccttccatttttgtttcaggggtagaagagacttntaagtttggaggcccttcctttgagctgagcggaggaggcacccgggtctctttagaggtctgggaagagatgggctcgagcttgatgctttgcaaagagcttagcccttt

SEQ ID NO: 192 - DNA, 722 bp, Homo sapiens
cttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaaa

SEQ ID NO: 193 - DNA, 2879 bp, Homo sapiens
gaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttca

SEQ ID NO: 194 - DNA, 3993 bp, Homo sapiens
ccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaaaaaaaaaaaaaaaa

SEQ ID NO: 195 - DNA, 279 bp, Homo sapiens
ggctcttgacgcgctggcgggagaccgaggtggggccgctgtaagagcccagtcgatcccgcctcgtgccctcagccgaggccccgaccgcgggcaccgacgcgctgctcgcccggcgccgcagtggctcctgccgccgcccttcggggtccccggccgcctgctccccagccgacgagacggaggtggcggaagccctgccgtggcgctccatgggcgcgccgagccggcccgctcccatccgcagcagcagtcgctgccgcccgagcaagcccccca

SEQ ID NO: 196 - DNA, 405 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagacctgggtgctgaggaaacactactgaattataccacacagaccgg

SEQ ID NO: 197 - DNA, 165 bp, Homo sapiens
gctttccctttgcttggtagatcttcctccatccctttattttgagcccatgtgtttctctgcacatgagattggtctcctgaatacagcacagtgatgggtcttcaatctttatccaattgccagtttgtgttttttaattggggcattcattccatttacatt

SEQ ID NO: 198 - DNA, 1662 bp, Homo sapiens
ccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttaaaaaaaaaaaaaaaaaaaaaaaaaaaaaaa

SEQ ID NO: 199 - DNA, 249 bp, Homo sapiens
gtcgaccgatttgaaacatttggcaatttgtgtgttggaaatacactcaccacagttgatttaaagctgtcaatgtaaagtcactgaagaaggagacaagatgtgcacaactagttcctatgtgtgagtatgagttggctccagcatactatcgaaaccccacgtgttcttggtagcctttcattcaacagtatttcaagaataacttttcctgtcaacaaatgttcctttgaaaaaaaaaaaaagtcg

SEQ ID NO: 200 - DNA, 1227 bp, Homo sapiens
ctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcacttta

SEQ ID NO: 201 - DNA, 6030 bp, Homo sapiens
gttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 202 - DNA, 1344 bp, Homo sapiens
tgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 203 - DNA, 3338 bp, Homo sapiens
gcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaa

SEQ ID NO: 204 - DNA, 2475 bp, Homo sapiens
gtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcaaggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggttcatagtctttattttgtcctttgaataaacattaaaagatttctaaacttcaaaaaaaaaaaaaaaaaa

SEQ ID NO: 205 - DNA, 1701 bp, Homo sapiens
cggccggccgccatggctaacgtggctgacacgaagctgtacgacatcctgggcgttcccgcgggcgccagcgagaacgagctgaagaaggcatacagaaagttagccaaggaatatcatcctgataagaatccccaaatgcaggagacaaactttaaagaaataagttttgcatatgaagtactatcaaatcctgagaagcgtgagttatatgacagatacggagagcaaggtcttcgggaaggcagcggcggaggtgggtggcatggattgatattttctctcaccgttttttgtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggtgaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccagagtggaacccggagacattgttctttttgctaccaggagaaaagaacatggaggtatttcagagagatgggaatgatttgcacatgacatataaaataggacttgttgaagctctatgtggatttcagttcacattaagccaccttgatggacgtcagattgtggtgaaatacccccctggcaaagtaattgaaccagggtgtgttcgtgtagttcgaggtgaagggatgccgcagtatcgtaatccctttgaaaaaggtgggctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtaaaa

SEQ ID NO: 206 - DNA, 230 bp, Homo sapiens
  misc_feature (194)..(194): n is a, c, g or t.
  misc_feature (202)..(202): n is a, c, g or t.
  misc_feature (218)..(218): n is a, c, g or t.
  misc_feature (223)..(223): n is a, c, g or t.
catctccttgcccaagggtgtggtggaggtgacccatgacctgcagaaacacctggctgggctgggctgactgaggccattgacaagaacaaggccgacttgtcacgcatgtcaggcaagaaggacctgtacctggccagcgtgttccacgcacccgcctttgagttggacacagatggcaacccctttgaccngggccatntacgggcgcgaggagntgcgnagcccca

SEQ ID NO: 207 - DNA, 314 bp, Homo sapiens
  misc_feature (303)..(303): n is a, c, g or t.
  misc_feature (311)..(311): n is a, c, g or t.
gtgagcactgtgtactgtgctcggtagtcatacagtcttaacatgtaactacatacagcattacatctgatctaaattttctcttcgagtacttaagccattaaaacatacagcagccattactctcacctgttgccatttctgctggaggtatgtatctttgactgagtacagatacttgttcatttggtcaagactcctgataatagccatcgagagtcatagtttcccagcaatgatattcacgagccaattttacattctcactaatcatagaggctcatgttcactgtaagctaaaangaggaggnaaa

SEQ ID NO: 208 - DNA, 481 bp, Homo sapiens
agcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 209 - DNA, 1126 bp, Homo sapiens
aagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttagctgtccccatccaactcccccaccccagtaaccactcagaataggtatggatttgcctattctggacgtttcgtataaatggcgtcatacact

SEQ ID NO: 210 - DNA, 393 bp, Homo sapiens
  misc_feature (4)..(4): n is a, c, g or t.
  misc_feature (44)..(44): n is a, c, g or t.
  misc_feature (240)..(240): n is a, c, g or t.
  misc_feature (251)..(251): n is a, c, g or t.
  misc_feature (305)..(305): n is a, c, g or t.
  misc_feature (320)..(320): n is a, c, g or t.
  misc_feature (363)..(363): n is a, c, g or t.
  misc_feature (374)..(374): n is a, c, g or t.
  misc_feature (387)..(387): n is a, c, g or t.
attnttttgatttttttttaacaatactgccctgctggcaacancacgatagtcacttgctcatctgaaaatgccttgcactttctttttcactagcttcgtgtatgacgcaaaacagaaatatttcaattacaggtgactaagagtaagaaaaatatacaactatatttaaaatacttaaattaacaagatagtacttttccattctaacaaaatatcatacattcagtttaaacaagngttaatatccngacacacggttttcaaaatacctggatgctaggttggaaaattggtggccctgngggctttcccagggntatttcttaattgggccaaactggtggttccaattttgagggnggtggtacccnccgtgctgggggngggccg

SEQ ID NO: 211 - DNA, 2857 bp, Homo sapiens
ctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaa

SEQ ID NO: 212 - DNA, 2110 bp, Homo sapiens
cagaggcctgatgaagactctgagttatgttattgtaccaagaaaggggcttttccccttgggccatcctaaaacaggtcttcccagcctctccttcctgagcctccatttcttgttagtagatgatggcatggtcaaagctgaaaattctcacaggcctcagggagccatcattaggggaaagggttcagatctgggagtatttgacagggaaagcgcctcctcctcagaaggaatctttttaggaatcactcgcctaagagagcccctaccctagacaagttgtactcaccagacctccagtctccaagccaatgtggttcacggactgcctgcttcagagccttctggggaaggactgaaaatgcagaattactgggttgtacccaaaagccagcgattcaaggtttctaagaggaagggcccaggaacctgcatcagattcttatgcacgcttgagtccgagactcactgctctcagcatccctttcctcggagctttaaaagcttccagagtctccttcctcttagcattttgagtatcttctaagtaagccaaggaaggtttttacttaacaatgtttggcttttggggagtgctctgacgcagctttgtgggcctccagaaccaaaggcgtgcgtgcttaatggtaggagtgtcatttgtccctaaccttattcctcggtccctgcagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaa

SEQ ID NO: 213 - DNA, 3942 bp, Homo sapiens
gggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgat

SEQ ID NO: 214 - DNA, 175 bp, Homo sapiens
tttttttttttttttgtgtgtatgaatgagaaaataactttatttcattttggggagcaggcagacattcagcctcagaacttctggaattgcttcttgatgtctgcgaccttggtgaccttgagcacattgaagtacaccgtcttgttcagggactggcacttatccaacgtga

SEQ ID NO: 215 - DNA, 419 bp, Homo sapiens
ttcggcacgatggacaggaagaaagtggtggagtcagaggtcacaatccaaagcaaggtgacagtctcttgacgaagacaccctgagtgctgaattaaggggctaaataacagtgctatagtggtttcataatcataaagcattccaggaacacaatattgcttatcaactgagctttaaaacagatatgaggcaggacatggtggctcacacctgcactcccagcaatttggcaagccaagctttgatggctctggcagaaagccttcctgttccaaactcaccacttatcatcatagtacccgcgttcaggcattaagaagaaaagagcatccaatccctctgctttcctgcatcggctcccatgcacaagcaaatgtgttgtgttagtggctatcaaatattcatgtatttgatca

SEQ ID NO: 216 - DNA, 2099 bp, Homo sapiens
aagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgttagtaataaacgtcttgccac

SEQ ID NO: 217 - DNA, 1581 bp, Homo sapiens
ccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaa

SEQ ID NO: 218 - DNA, 5888 bp, Homo sapiens
atatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaatggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagtcgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgataaaaaaaaaaaaaaa

SEQ ID NO: 219 - DNA, 2179 bp, Homo sapiens
accgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcaaaaaaaaaaaaaaaaaaa

SEQ ID NO: 220 - DNA, 414 bp, Homo sapiens
cctttccgatacttcatttattgtctaaatatttttgcgtctcagcgggcccctgtcgctcttggctgataggtcccagttctctccccgacccctccctgaggaggacgttgcctcctgcccggatcgccccagctgctgccagtttttcttctctctttgtagaaggagaagggggaggggtgcagatgcgatgctgtgaccctccccgctggcctccacaggcctggggcttgctcacaggctgggatgaacagggacagggtggcttccccctcggttccccacctctggacatggggggcgggcaccacagaggaaaatgagtgcacaagtccccggccgagtcaggagcgtggactctggcaccgacttgccgtgtgacctggggcaggtcgcttccctgatgcagca

SEQ ID NO: 221 - DNA, 1816 bp, Homo sapiens
cgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggt

SEQ ID NO: 222 - DNA, 343 bp, Homo sapiens
  misc_feature (290)..(290): n is a, c, g or t.
tagaatcagtgggagccctgagtttgttttcctgcaattagacaggcccgtcttttggccctccatgaccccctatcctgtacccgtataaactccagacaccaggcatccttcaagtccatgtgtgacctgattcttctgggaggtgagacaagagctgagatacagaaactgtcacactgaccctctgcgcttgcaaaaaggcagagggtctattgagctggttaacacttaagccgtcagctgatggtaaggctaaaagagcacactgtaacacacgcccatttggnttcccgggaatcacgggatcctgcccctgggacactgccgtgggggctgggaa

SEQ ID NO: 223 - DNA, 5431 bp, Homo sapiens
tgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctggcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaaaatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttgagtttttctatctgtgtacttttttttaagggaaagattttaatattaaacctggtgcttctcactcac

SEQ ID NO: 224 - DNA, 1125 bp, Homo sapiens
gtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctac

SEQ ID NO: 225 - DNA, 459 bp, Homo sapiens
gcttttcaatgaccctatttttattcacgagaacagcacatacatgtgtttgaaaattatgtgaggtgctcactctgcagacagtactcacattcctatagattccacccctgcccaccttgcagcccctggagtctatagcagatgggagtggggcactccgagagtggcaggcctggagatcacatcttccattgttccttcaatcaacactaactcccatttgggccttaggtgccttgctaagcaccacaaaacagcaactaactgaaagagatctggagtgccagcccgctcctactgagggcctcctctctgtcaggcaccttgcaaagcattttgtgtgaagtgactcatttaacctcaccacaacgccacaacgcagggattatgcaggtaacctatttcccagatgaggaagataaggcccaaggaggtgaaatgcctttcccagagtta

SEQ ID NO: 226 - DNA, 374 bp, Homo sapiens
ggaatagaatcactgggttatatggtatcttaactctatatttaaccctatacaagactgttttacaaagtggctgcactattttaaattcccaccggccacttgtgaggttgtaatttctccacattgttaccaacacttgttattgtctatctttaaaaaaaaattagctatcttagggggtgtgaagtggtatcttgttacagttttgatttttattttcctaatgactaaggatgtacattgagcatcttttcatatatgagctattatttttatagaattgaaagattggaattaagacaatagaatccataacctggataaacactattgctttcattagggaaaattcatcattaaagttcttcaaa

SEQ ID NO: 227 - DNA, 3310 bp, Homo sapiens
ggcacgagggcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctgggcactgcttccagtgaggctctgcccttggttaggsattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcargggagtgagttgatagcacagaccctgccctgtgggcccccaaatggaaatgggcagagcagagaccatccctgaaggccccgcccaggcttagtcactgagacagcccgggctctgcttcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccaggggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaaaacgctgtgctgccctgcccaccctggcctctgcactcccctgctgggtgtggcgcagcatattcaggaagctcagggccctggctcaggtggggtcactctggcagctcagagagggtgggagtgggtccaatgcactttgttctggctcttccaggctgggagagcctttcaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaaaaaaaaaaaaaaaaaaaaaaa

SEQ ID NO: 228 - DNA, 381 bp, Homo sapiens
tttttctagctcactgttctattctcagagccactggcaggcacttaatacatatttgaatgaatgtgtctccttcgactttaaaaatgcccccaccgggaagtgcgtgggggatgtgggaaggccggaaaccatttctgcagctgccagtccccttccaggccctgtcatgggatggagcagggcatcactgtgcggcgccttggcctgtggatcccctccccacgtttcttgcccggtgcaggccggaaggcaggcaggtacaagcaaggagtcggctctacgcgcagagccccaggggagcggcccgtgctgggcatggcagtcccagcagtgcatttgtctagctgccggcccggggtccggggccacttcctctct

SEQ ID NO: 229 - DNA, 1412 bp, Homo sapiens
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgta

SEQ ID NO: 230 - DNA, 3328 bp, Homo sapiens
gttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagggtctggaatggtctggagtggtctggaaagcagggtcagatacccctggaaaactgaagcccgtggagcagtgatctctacaggactgcttcaaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaaaaaaaaaa

SEQ ID NO: 231 - DNA, 1075 bp, Homo sapiens
gttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 232 - DNA, 464 bp, Homo sapiens
tttcaatttaataattttttaataagtaaaaaaatcttgtagcatgcaaaaacttaccagttccccaagttttcattaccctgtctcatatttagtatatgtgctgcatctggcaacaatgatcatcagaagcctaggacagtataatattactaccataaatcataagtaataggatgattttagcaaaactctcattttggttttctagaacctacctccaggctacttaagtacttaatttctttcaactcttaattctatgtaaatctacattactagataagataatggtactcagaaatgtattacatccattaagctacctgattggctgcaaaagctggagcagtttctttagaagtcttccaaacaaactgcctttgatattcagaatttctgaaggcattatatgaaggaacaacagtcaatccagctttcttacgcagaagtctatccaactg

SEQ ID NO: 233 - DNA, 1451 bp, Homo sapiens
gaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatc

SEQ ID NO: 234 - DNA, 489 bp, Homo sapiens
tttagctaatagtttttctttaataatcagttacataatacaaataacacccaaaaggggaagatccaacaatttagagatccgcagtattcgcagagaaattctgcctatgagatctcaaggcacccagaactcaacaaggctgttcttcacctccaggtggagcatgtctttcaagtgagcttcattttcagcccagtaactaagctgcaaattatcttctcaaacacacacacacactgagcaggatgccaatggaaaaccagacaaatgcctgctttctcacttggcttcagaagacacaaagcatggttactgtgggatgtaggataaatttctaagtctgccaaattaaattatatttttatactacatcctcaaggactcttccctggaaatgaatgtttcgcaaaatgtcgctggcctcaagagcagtttccgtggactacacagttaccataggttgagctaaatgcagagcatactttg

SEQ ID NO: 235 - DNA, 1412 bp, Homo sapiens
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgta

SEQ ID NO: 236 - DNA, 553 bp, Homo sapiens
ttttattaggctttttattttgagataactataaatgtacatgccattatgaggtaatacaaggacatcacatgtgtcctctaccaagtttcctccaatggtaacttttgcagaactgtagtcaagagcacatgcatgatcctgccactgctattacagttccatgactacaagaatcaatggggtctttttaatgatgagaaatacacggtagatttaattcacagttactatacaaaatgtgtggatacaaattctttaaagctaattctcctaaccttccctcctcctctgacaaagtatttggttaaactaatatgtgaataatatttagttactttcttgctactacccaaatgggacaataataaaatttcctcccttccattttgtttgagagatcttagttaaaacaatctcagaagatttccatatcaacaatgcagaaagttgcttctctgataaacaatagaagccactgtaaaaatacagcaaagtctctgtgagttggtgactccatggagctcagcaggcgcagaaataggtgcccttg

SEQ ID NO: 237 - DNA, 1963 bp, Homo sapiens
cgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtttttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcat

SEQ ID NO: 238 - DNA, 475 bp, Homo sapiens
agttgtatgtaataattgtactatttatgggacacagtgacattttgatgcacgtacacaatgtgtaataaatcaggaccatcacctcaaacatttatttttgaacattcaaaacccgtcctctagctttctgaaaacacgcactaaattatcgttagccacattcaccctacagtgctacaacacaccagaacttactcctccaatctagcagtcactctgtatctgataacagacctctcaacagacctctccctatttatcctcccctctctctccctcttagcctttatcaacaattctctgcttcggtgagctgtttttgtagctcccacatgagtgtgaacgtgaggtatttcccccctttctgtgcctgattttccgttgagtcctaattttcaactcttctgacataaaacaaaacaaaaacagcaacaaaaagatacctgcaagtatctagacaaaaagtaaccca

SEQ ID NO: 239 - DNA, 532 bp, Homo sapiens
  misc_feature (6)..(6): n is a, c, g or t.
  misc_feature (8)..(8): n is a, c, g or t.
  misc_feature (10)..(10): n is a, c, g or t.
  misc_feature (143)..(143): n is a, c, g or t.
  misc_feature (153)..(153): n is a, c, g or t.
  misc_feature (172)..(172): n is a, c, g or t.
  misc_feature (176)..(176): n is a, c, g or t.
  misc_feature (228)..(228): n is a, c, g or t.
  misc_feature (237)..(237): n is a, c, g or t.
  misc_feature (271)..(271): n is a, c, g or t.
  misc_feature (413)..(413): n is a, c, g or t.
  misc_feature (435)..(435): n is a, c, g or t.
  misc_feature (448)..(448): n is a, c, g or t.
  misc_feature (464)..(464): n is a, c, g or t.
  misc_feature (484)..(484): n is a, c, g or t.
  misc_feature (496)..(496): n is a, c, g or t.
  misc_feature (502)..(502): n is a, c, g or t.
accatnananagcctttaattttacatgtacaaatgctgctgtaaattcgtaacagcgaagaaaaatatatacgaaccggtttaaaaggaaaagtaaaaaacaatccacagttgagcagttgatgtgcaaatcatcccagggntccaactttntgtctcttgggccccaggntttnttccttgtgcacaacactctgcaaggaggcatgcagtaccttgcccacacgnttgccagtntccatcatctcgaagatgctctctgggtccaggntgcccttccccactttcctcatgcacgtcacaactcccttgctgggtcaccgacaccaggcaagctggccagcgagcaggcctcctcctgaagagtaggcatccaccacatgccgatagccaattttggcacagagtgacantggcaggggacattttccacanttagtcgtattgnagtcataagggtcatntgacaattcaatggtccttngacccctttttnatcctncaaatttggacccttgggtttcctggggtg

SEQ ID NO: 240 - DNA, 1166 bp, Homo sapiens
gagagacagaggcaccccggacagagacgtgaagcactgaataaatagatcagaatgactgaaaaagccccagagccacatgtggaggaggatgatgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgag

SEQ ID NO: 241 - DNA, 624 bp, Homo sapiens
ctggcatcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacatgctctggaggagaaagattggtcctcagatgaccctttctcatgctgcaggattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcgtgagaatgctgaagctggacacacggatcaagaccaggaagaattgaacttgtcaaggtgaagggacacaagttgccagccaccaactttcttgcctcaactaccttcctgaattattttttaaagaagcatttattcttgtgttctggatttagagcaattcatctaataaacagtttctcactt

SEQ ID NO: 242 - DNA, 482 bp, Homo sapiens
  misc_feature (242)..(242): n is a, c, g or t.
gcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacngaaacagatagtggaaatcctgacagcatatgccagcgccgtaggaataggaaccactcaggtgcagccagaagtgaaggtttaggaagattttcataaagtcatatttcatgtcaaaggaaatcagcagtgatagatgaagggttcgcagccgagagtcccggacttgtctaagaaattgagcaggtttacaagtactgttctaaatgttaacacctgttgcatttatattctttccat

SEQ ID NO: 243 - DNA, 296 bp, Homo sapiens
  misc_feature (180)..(180): n is a, c, g or t.
  misc_feature (199)..(199): n is a, c, g or t.
  misc_feature (229)..(229): n is a, c, g or t.
  misc_feature (270)..(270): n is a, c, g or t.
  misc_feature (287)..(287): n is a, c, g or t.
ttttttttttttaaccaatccgttttttaattcttaaattcttgacattacagaactaaactgaaatttattaacattccactcttacatttcttatcgacaaacagaaataaaattcatgagccaaaaaacccaaaacaaaactaaaaacagggaaaagcttataaaactaaatatggntcccagcattaacagctgnaacagagaatgtgatttttaaattcttagncgggatgataaagttgtgtaggaaactggaacacttacaanttatttaaaaccggggntcactgacc

SEQ ID NO: 244 - DNA, 443 bp, Homo sapiens
ttttttttgctttaaatatttctttgggggagaggacaccacacttctactcaatgaagagaaacatttttgtagcccagaggtcctttatttttttttttaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagagtgcttaatgtgctcaatacgcacattaattctcttggcaagaatcttggccttaacttgtttgttttacaacaatgccaacagcatgctgggtaacattgtagactcttccagttttgccatggtaacacttgtgggggcaatc

SEQ ID NO: 245 - DNA, 461 bp, Homo sapiens
tttttttttgagacagggtctctctctgtcacccaggatggagtgcagtgatgtgatctcagctcactgcaacctcaacctcctggctcaaatgatactcccgcctcagcctcccaagaaactgggaccacaggcgcgcaccacgatggctggctaatattttgtatattttgtagagatggagtttccccatgttgcccaggctggtctcaaactcctgagctcaggtgatccgcccaccttggcctcccaaagtgctgggattataggcatgagccactgcacccagcctttgtccatgattttgacagcatgacctgctaattctaccagagactccagtgggaacacttcaggcaaaataggctttgacttcccacagtttccattccttttggcagataaaataagggaagtaagttacacctttgggttaaaatttgggcatttggggcagtttg

SEQ ID NO: 246 - DNA, 221 bp, Homo sapiens
ggaaaaggattcagtttattctctggctccaaggaacaaacttgatattactgaggaagttatagacatggattttagcttaatgcagatgctcctttacttacaacgggcttcatcccaataaactcatcgtaagttgaaaatattgtaagttgaaaatgcacttaacatatctaagctcccaaagattcacagtttagcctagccttcctcaaatattc

SEQ ID NO: 247 - DNA, 1815 bp, Homo sapiens
ggggagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaagctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggcgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttc

SEQ ID NO: 248 - DNA, 366 bp, Homo sapiens
  misc_feature (329)..(329): n is a, c, g or t.
  misc_feature (354)..(354): n is a, c, g or t.
ttttttttatggtaataacattttaataggtttaaaccaaataattctaatatctctaaaaataatcaatttgaaatgcttaggatatggttcttttttttataattaactcatctttgagcaaacatgtaatgttgagtttaatatcagtgtcaatttcttaaatattaaggtatatgtagtcttgtttgggatcagtggggggaaaaaaagtgcatttcctaaaaggtaattgtattgtatatttcagggagagtagggggtgaggatttacacaatgtccttttgttattttctcttcccggttattaaacaaacaaacacaacancggaaggctctggttctttaccggnttttgggtaaaa

SEQ ID NO: 249 - DNA, 520 bp, Homo sapiens
  misc_feature (380)..(380): n is a, c, g or t.
  misc_feature (404)..(404): n is a, c, g or t.
  misc_feature (422)..(422): n is a, c, g or t.
  misc_feature (480)..(480): n is a, c, g or t.
tcctctaaaaccacagtaaattgctccatttcctaaattacctcttcaagagaagactggttttgatgtcatttttaaataaaggagaagttgaatttcaaaaccaagtggaacaggaatgatgtgacttggttgacattgattttaacatttggttcatggtgagtgttttgctttattgttaaaaactcgccactaaaagcatgacagaacattttatcaaatgatggcgtcatcctttaccgtaagtttgcccctagcaagacagctcttcctgagacgtgcttgcaggcccctatgtgggttttcccaccgcagtcatcatccgtcatctgtgaccttgctgcatttactccatgctcacaccccagcagcccgcnggggtttgggcatcgcccttcagngggcatcaaacttccccnggtggcaatgttacaagagttaggccagggaggttggcaggagtgttttgggttttgntttttgttttttttgacatgtcggctgggttgggagtatt

SEQ ID NO: 250 - DNA, 1759 bp, Homo sapiens
cccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatagactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaaaaaaaaaaaaaaaaaaaa

SEQ ID NO: 251 - DNA, 955 bp, Homo sapiens
tgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgtgagtttcttggtctgaaatacttaaaaaatatatatattgttgtgtctggtaatgaaagtaatgcatctaataaagagtattcaatttttt

SEQ ID NO: 252 - DNA, 1127 bp, Homo sapiens
cacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 253 - DNA, 1195 bp, Homo sapiens
cactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaaggagaaaaaaacacagttgttactcggtaatgagggatgttgggactcagacgataccctaaagtatgacactttgggatactgagtactttgagctaaaggagactggaaggcctcagaagcaagatctctgtgaccttctccttccatcttccctcttgccccaagtcttcctcttccaaagcaagtcataaaaaccagaattcaccgggcgcagtggctcactcctgtaatcccatcactttggaaggccgaggcagaggatctcttgagctcaggagttcaaaaccaggctgggcaacatagcaagacctcatctctatgaaaaaaattttaaattaaaaaattaaaaatta

SEQ ID NO: 254 - DNA, 438 bp, Homo sapiens
gatcaggaaggaaatttattgcacaagaatgggaagaaattatcaagttaactgatgtgtaagggaggtgtacctggaagatactctttaataggcaatgcatgtgtggggatatttttaagttttatcggtacaaatgaaatatattgaacacaaatcgagcaaatatgacttggtcgttaacatccctctgattaaacaggagtgctgctatgagaacgggctgtgccattctgcaggcacacgagagtcgctgggttttagggtagtctctgtggagaatggtgactggaccacgtgggagaggggcttgaggcaggaaggtgagcagactccagagttcaagagatgtttgcatacagtgccctcttgtttccccttacagtgtggctgtggccagtattgagaaccaagtgttcaggaactcatgctggcctg

SEQ ID NO: 255 - DNA, 489 bp, Homo sapiens
  misc_feature (297)..(297): n is a, c, g or t.
caactttggtgaatctgacaaatatgtgtcttggagttgctcttctcgaggagtatctttgtggtgttctctgtatttcctgaatctgagtgttggcctgccttgctagattggggaagttctcctggataatatcctgcagagtgttttccaacttggttccattctccccatcactttcaggtacaccaatgagacgtagatttggtcttttcacatagtcccatatttcttggaggctttgctcatttctttttattcttttttctctaaacttcctttcttgcttcatttatntcatttcatcttccatcactgatacctttttcccagtttgattgcatcggctcctgaggcttctgcatctcaacggtattctcagccttgggttttcagctccatcagctcctttagactccttggaatttgggtattctaagtatacttcctctaaaattttttcaaaggtttcaactcttgcctttggtt

SEQ ID NO: 256 - DNA, 2780 bp, Homo sapiens
gcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctgatt

SEQ ID NO: 257 - DNA, 2964 bp, Homo sapiens
agtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaaaaaaaaaaaa

SEQ ID NO: 258 - DNA, 1782 bp, Homo sapiens
gggagacacacacagcctctctgcccacctctgcttcctctaggaacacaggagttccagatcacatcgagttcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgttgataggtcaggaaatgttcatcaccagtttcaaaagcttctgactgaattcaacaaatccactgatgcatatgagctgaagatcgccaacaagctcttcggagaaaagacgtatcaatttttacaggaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaagaatacatacaaatctgtacagatgatgaggcaatacaattcctttaattttgccttgctggaggatgtacaggccaaggtcctggaaataccatacaaaggcaaagatctaagcatgattgtgctgctgccaaatgaaatcgatggtctgcagaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccatagatgcaattagtctgtcactccatttagaaaatgttcacctagaggtgttctggtaaactgattgctggcaacaacagattctcttggctcatatttcttttctatctcatcttgatgatgatagtcatcatcaagaatttaatgattaaaatagcatgcctttctctctttctcttaataagcccacatataaatgtacttttccttccagaaaaatttcccttgaggaaaaatgtccaagataagatgaatcatttaataccgtgtcttctaaatttgaaatataattctgtttctgacctgttttaaatgaaccaaaccaaatcatactttctcttcaaatttagcaacctagaaacacacatttctttgaatttaggtgatacctaaatccttcttatgtttctaaattttgtgattctataaaacacatcatcaataaaataatgactaaaaaaaaaaaaaaaaaaaaaaaaaaaaaaaaaaaaaaaaaaaaaaaaaacccaaaaaaaaaaaaaaaaaaaaaaaaaaa

SEQ ID NO: 259 - DNA, 423 bp, Homo sapiens
  misc_feature (339)..(339): n is a, c, g or t.
ttttttctaataagatattttatttagtccaacatatccaaaatattatcatttcaacacataacaaatacaagataatcattaatgtgatattgcacattccttttctgtactaagtctttgaaacaccctgagtattttacacttaacatacattttaattcagactacccagattccaagcattcaatagccacgtgaggctagtgactatggtattaatcagtactactctagaaattttgctttgaaagtcagatatggatagaaaataaagttaattagaaaatatgtattcttcttgaaatacatcttataatacagttatatttatattanttttgttttggctataatttttcttttttatatgttttgcaaggaagtcagggtttagaggaagtaaagtttttttttgtaatg

SEQ ID NO: 260 - DNA, 956 bp, Homo sapiens
gagcccggggtgctggagggaggcggcaggcccgggtcaggtgcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 261 - DNA, 513 bp, Homo sapiens
  misc_feature (466)..(466): n is a, c, g or t.
cactcacactggaaaggacaccagatacttcttgggccctcttcccttttctatattttctttctgttatttgatacagtctcattgctttaaatatcatctaaatactccacagcattttggcagatctgtataaccaaactgccaaaatttccagttggaaatctaacaggtatctcaaaccaacatatctaaaactggattctggccacgtgtggtggctcacacctgtaatcccagcactttgggaagccaaggtgggaagatcacttgaggtcaggagttctagaccagcctggctaacacagtgaaaccccgactccactaaaaatacaaaaattagccgggtgtggtggcggacacctgtaatcccagctattcgggaggctgaggcaggagaatcactttgaacccaggaggcagaggttgcagtgagccaagatcgcgtcaccgcactccaacctgngtgacagagtgagactctgtccaaaaaataaaaaaataaaattggat

SEQ ID NO: 262 - DNA, 418 bp, Homo sapiens
tttaacctttaggatcaaaaatttattaaaaaccaattatatcaacaggcatcaagtctacagattcaggttacaccagaccatgaagtaaattctgtccccatccacaccatacttgccaggtcttctagactcctgagccatctccctatatcctcatccaaattcccagattacaggcttaggtttttggtttggttttcagtccaatggaggtgggggcagctatgtgttgatttttggcaccaccctgtggtcatacctaaatattgcaccttctactcaatcccacaaagggaaggaaacatgtatgtagagggcccagccgacttcaaatctcagctctacttcacagtaaaactgtgggcaagccaactaactggaggggccgtgattataaccatgtaaagatgtgtat

SEQ ID NO: 263 - DNA, 1443 bp, Homo sapiens
gggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttccccgtaaaaaaaaaaaaaa

SEQ ID NO: 264 - DNA, 800 bp, Homo sapiens
cactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatatt

SEQ ID NO: 265 - DNA, 237 bp, Homo sapiens
tttaatggatccaaggccaaatacagtcttcagggtcatgggaacctaaaggtaattctcaactgtccactcttattttggttgtgtttggttttttaagaaaaattgtcatagaattagaggaatgaaaaggggattaaccattctagccaagcctccatctttttcattttataaatgttcagaaaatgcacctgtgtagtccccgacccccactccccaccattgtgtctcaat

SEQ ID NO: 266 - DNA, 533 bp, Homo sapiens
tttttttttttttttcaaatataactttatcatttatttccagtaattatttttacaactttcctgtcttctgttatctgttgccatctgagtttacagggtgccataactggagcttaatccctttttacagccaacatgattctcagtcacataaaattggttcagtctgttgactactccttcagcagctgcatatcacctcattctttccacttgcacatgacgcactggataaacccagcgagaagctgagagttcatttgtccttttggagagaggctagagtcagatgcttcatctagagattccagtcagctcttcttggttggcaattcctcttaccatcaatctagtgttgactttgggtaaactacttaatctctttagcatctgcatcctcacttgtaaaatgagaggtttaaattacagtttccttccagcgtgacttgtcatagcctcttgcctcagctgccctcgcctcgatccaggcggggtcaggatgcttcttggtgttccactgtgggctcggc

SEQ ID NO: 267 - DNA, 1324 bp, Homo sapiens
cggcacgagcgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaaaaaaaaaaaaaaaaaaa

SEQ ID NO: 268 - DNA, 777 bp, Homo sapiens
aggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 269 - DNA, 2470 bp, Homo sapiens
gacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaacactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagt

SEQ ID NO: 270 - DNA, 3561 bp, Homo sapiens
agtgtagctgcgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggaccccaagatccttaagttcgtcgtcttcatcgtcgcggttctgctgccggtccgggttgactctgccaccatcccccggcaggacgaagttccccagcagacagtggccccacagcaacagaggcgcagcctcaaggaggaggagtgtccagcaggatctcatagatcagaatatactggagcctgtaacccgtgcacagagggtgtggattacaccattgcttccaacaatttgccttcttgcctgctatgtacagtttgtaaatcaggtcaaacaaataaaagttcctgtaccacgaccagagacaccgtgtgtcagtgtgaaaaaggaagcttccaggataaaaactcccctgagatgtgccggacgtgtagaacagggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtggtggaggaggtcccgaacgtgtgcacagagtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagttgccagaggagccacagcgtctgctggaacaggcagaagctgaagggtgtcagaggaggaggctgctggttccagtgaatgacgctgactccgctgacatcagcaccttgctggatgcctcggcaacactggaagaaggacatgcaaaggaaacaattcaggaccaactggtgggctccgaaaagctcttttatgaagaagatgaggcaggctctgctacgtcctgcctgtgaaagaatctcttcaggaaaccagagcttccctcatttaccttttctcctacaaagggaagcagcctggaagaaacagtccagtacttgacccatgccccaacaaactctactatccaatatggggcagcttaccaatggtcctagaactttgttaacgcacttggagtaatttttatgaaatactgcgtgtgataagcaaacgggagaaatttatatcagattcttggctgcatagttatacgattgtgtattaagggtcgttttaggccacatgcggtggctcatgcctgtaatcccagcactttgataggctgaggcaggtggattgcttgagctcgggagtttgagaccagcctcatcaacacagtgaaactccatctcaatttaaaaagaaaaaaagtggttttaggatgtcattctttgcagttcttcatcatgagacaagtctttttttctgcttcttatattgcaagctccatctctactggtgtgtgcatttaatgacatctaactacagatgccgcacagccacaatgctttgccttatagttttttaactttagaacgggattatcttgttattacctgtattttcagtttcggatatttttgacttaatgatgagattatcaagacgtagccctatgctaagtcatgagcatatggacttacgagggttcgacttagagttttgagctttaagataggattattggggcttacccccaccttaattagagaaacatttatattgcttactactgtaggctgtacatctcttttccgatttttgtataatgatgtaaacatggaaaaactttaggaaatgcacttattaggctgtttacatgggttgcctggatacaaatcagcagtcaaaaatgactaaaaatataactagtgacggagggagaaatcctccctctgtgggaggcacttactgcattccagttctccctcctgcgccctgagactggaccagggtttgatggctggcagcttctcaaggggcagcttgtcttacttgttaattttagaggtatatagccatatttatttataaataaatatttatttatttatttataagtagatgtttacatatgcccaggattttgaagagcctggtatctttgggaagccatgtgtctggtttgtcgtgctgggacagtcatgggactgcatcttccgacttgtccacagcagatgaggacagtgagaattaagttagatccgagactgcgaagagcttctctttcaagcgccattacagttgaacgttagtgaatcttgagcctcatttgggctcagggcagagcaggtgtttatctgccccggcatctgccatggcatcaagagggaagagtggacggtgcttgggaatggtgtgaaatggttgccgactcaggcatggatgggcccctctcgcttctggtggtctgtgaactgagtccctgggatgccttttagggcagagattcctgagctgcgttttagggtacagattccctgtttgaggagcttggcccctctgtaagcatctgactcatctcagagatatcaattcttaaacactgtgacaacaggatctaaaatggctgacacatttgtccttgtgtcacgttccattattttatttaaaaacctcagtaatcgttttagcttctttccagcaaactcttctccacagtagcccagtcgtggtaggataaattacggatatagtcattctaggggtttcagtcttttccatctcaaggcattgtgtgttttgttccgggactggtttggctgggacaaagttagaactgcctgaagttcgcacattcagattgttgtgtccatggagttttaggaggggatggcctttccggtcttcgcacttccatcctctcccacttccatctggcgtcccacaccttgtcccctgcacttctggatgacacagggtgctgctgcctcctagtctttgcctttgctgggccttctgtgcaggagacttggtctcaaagctcagagagagccagtccggtcccagctcctttgtcccttcctcagaggccttccttgaagatgcatctagactaccagccttatcagtgtttaagcttattcctttaacataagcttcctgacaacatgaaattgttggggttttttggcgttggttgatttgtttaggttttgctttatacccgggccaaatagcacataacacctggttatatatgaaatactcatatgtttatgaccaaaataaatatgaaacctcatattaaaaaaaaaaaaaaaaaaaaaaaaaaaaaaa

SEQ ID NO: 271 - DNA, 457 bp, Homo sapiens
atgataaagtgaaaaaactttattggaaaaataagggtttactcaatattctccacaaattaaaatccattttgaggacagcgaataatacagtggcatactgatagtcctgagattgtaaggactggagtaacccactagggaatggcttacttatttttgtctcatttcctgaggtgtaaagggaaagaaggtgggaatttaatcatgacaacctcggttttaaacacccattcatgcaaccacagtaacctgatctatgatttaaggtaaaatgacttctgttaataataaagtctaagactatttaagataaaaggacaacaaaaaaagaactcgttcaacatacctttaaattggccacgggtacataaataaaaagtccttttaaattcaacaatagaaaatcagtagatctggatggaaggcagctcagaggaacagaaccaaacaagtt

SEQ ID NO: 272 - DNA, 312 bp, Homo sapiens
  misc_feature (205)..(205): n is a, c, g or t.
  misc_feature (305)..(305): n is a, c, g or t.
cttttaaagaagggtgaaattccactcagtgacgtgaaatttccgtctgactatacatttcattcacatccactgttttggcactggtaacaaacagttgcattcaaaaccagcaaaaatgaaacaaaataactttttttttggaaattaatcttattgaagaaattcactttcaaactatgtccctataatcacaaactaaagngaaaacatctatgtcgttttcaatacaaatatgtacttgttttaggctgacaatatttttttttttcagctaggaaaacccttgacaacaattctaaggncaccagt

SEQ ID NO: 273 - DNA, 296 bp, Homo sapiens
ttaaatgtatttttagtgtttactgaggttatctctgggtaatgaaggtgcattaattttctaggtgatgctgtagcgaggtaccacaacctaggtggcttaaataagtggaattggttgtggtatagctctggagactagatcaagttgtcggcaccactggctccttctgagaactgtgagggaaaaatctgttccaggcttcttcttttgacttttagatggccatcttcttcctgtgtctggtaaatctcgataaagcaccacagaagttacaagatacagtaagaaaagaa

SEQ ID NO: 274 - DNA, 601 bp, Homo sapiens
  misc_feature (450)..(450): n is a, c, g or t.
  misc_feature (486)..(486): n is a, c, g or t.
  misc_feature (566)..(566): n is a, c, g or t.
  misc_feature (571)..(571): n is a, c, g or t.
  misc_feature (578)..(578): n is a, c, g or t.
ttggctgggtaaaatatttattaattatccaaaaaggctcataccgcaagtcctgggagtggggggtgggtggctgggacagggcctcctttgaggccacccacacccaaggggcacagcagccctgagacgtccgttcacaaagggcagacgtgaaggcccctggtgggcggccaccacatgcccgagccctggcctgtgcagccttaagtagcccgtcagggcggtggggggatgtgggcgcccaacaggtcgtaggcgaagacgttccagaagacggcgaatagcaggaaggtgccgtaggccagcagcaccacccaccagccgcactggtcccgcaggcgctcctcgtagctccgcaggatggtcaggcccatgctcacccccaccaccgcgcctgccaggtgcgccatgaagctgtgctgtgggcccgaggcgggcagcggcggngagaagcgcagccacacagcgctggcccacctctgnagctcatgcacaccaaggccagcaccatcctcagcaacttgtagggacatctcatcccagcccagttcatgacaacgttngccangtgtgangagcacagggctgagaccccgct

SEQ ID NO: 275 - DNA, 439 bp, Homo sapiens
  misc_feature (256)..(256): n is a, c, g or t.
  misc_feature (332)..(332): n is a, c, g or t.
  misc_feature (399)..(399): n is a, c, g or t.
  misc_feature (408)..(408): n is a, c, g or t.
  misc_feature (413)..(413): n is a, c, g or t.
ttttttttttgctgtgttttcatgctttaattcagagttgtctgctgcaggtacaactctgtctgaacaaaaggacaaaggagacaagagtcaagatccctccccgcctccccacttcccacatcccctgaattcttcgtgaaggggatggcctaatatgggaatgcactgtgacctgtttgcattgtcccctaggtcagagagggggttgtgagttctctgggcagaggcccctgggttaggccttggccccagnaaccttgcagtttgtcccacccctccccaaagtgctgtaagatacccctgcgcttgtgggcaattggggaagggtntgtcagtgagaagctaagtgatccccttggggaggaaatctacaataaacttccactcaagcccagnttttctgtngcagnagcccggggccccagcgttccgattt

SEQ ID NO: 276 - DNA, 240 bp, Homo sapiens
tcctcatggtaagatttattattctccgctctgtacaagccgcgtctgccatcccgccccccatgcgcccaccccaaaaagcacccagcactcccttgtgccctcccaactctgctcatactccactgtccagccagattccaaaggttggggaggggcggtttatacccatctccgccaaaacttactgggggcagagtgctgctggggcgggggatgatgcgggtcaaaaacgagggt

SEQ ID NO: 277 - DNA, 356 bp, Homo sapiens
  misc_feature (229)..(229): n is a, c, g or t.
  misc_feature (252)..(252): n is a, c, g or t.
  misc_feature (264)..(264): n is a, c, g or t.
  misc_feature (330)..(330): n is a, c, g or t.
  misc_feature (351)..(351): n is a, c, g or t.
cagaaaagtctcaacaccacaatttatctgtttaatgttttcatttacatttggctttatcccaaaaagggtttaacagtgtcaccaagttaccaggtctctgtttcatcatatttacacaagatgaaggaaactcaatctgttcgtatttgccccaggtaataggttctatgtagtgacaggcatttcactatttgacttagtgtttgccaaaatgaagtaagggganttgggtccagagctgaggacagntccatttgggantgaaaggcataataaccttgaaggttattccagtgacaaaaaatgatccagtgaaaggttttctangggccaggccgggttgagggnggctg

SEQ ID NO: 278 - DNA, 2591 bp, Homo sapiens
ctcagactgtccttcctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgttggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctggggatgcacctcttctttgattccctgggatagtggcttctgagcaaaggccaaaaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaattctagaaagcttaaaaaaaaaaaaaaaaaaa

SEQ ID NO: 279 - DNA, 3288 bp, Homo sapiens
gctgtattgagttggtattctggatgatacaatttttagggctagaaagtttagagtgttggctggctcacaggctgcaaaggaaataatggtggagtccagaccacagcagtaatttcaattactaacacaaagaaacccattgtctgcaataatgaatataactgcagtgtcttgttttgttttaaattcttgtgtgcgatgaagggggcgaatctatcagacaacctatcaattgggctgatgatgtcagtgttccagtggcttctaacaggcgttaatacctgttggaaatggattatcattggctgggacgattgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagttgacaggtgggggcggcaatgtgacgctcactctgcccgtcaacaacctcgtgaacgccagtgacaccggggcccctactcagctcctcactgaaagccccccaaccccactgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtttgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttc

SEQ ID NO: 280 - DNA, 431 bp, Homo sapiens
tttagctgagcatctttattggactcaaaaacaatttcataaacaagtaaatgagaacttcacattttctgaaccttgaaggttttttcctcaatttcattcttttaaaaataccttttaaattaattcagcaaggttcttaaacacagcaaattgacaaatatcaactgagtgtctgttctgtgcaaatcactctgtaacagcttgctggctttacattctcgagggctccctgcctccagagcaccctggttttcggccctgcacgcatcttttctctgcaccttggctggttggagcagtttcagtagacaggtcctgattgacccaacatttcagagaacatgcacagagcatagtcctccttctaaatcagggattctcaaatttcagtgagcagaactcccctgggtgcttgtttacacgtagat

SEQ ID NO: 281 - DNA, 305 bp, Homo sapiens
  misc_feature (189)..(189): n is a, c, g or t.
  misc_feature (266)..(266): n is a, c, g or t.
  misc_feature (272)..(272): n is a, c, g or t.
  misc_feature (285)..(285): n is a, c, g or t.
  misc_feature (304)..(304): n is a, c, g or t.
tttctagttaatttatttgaaaagttgatattttatgctctagtttctggcatgagatataaaacgtgccactgctctaaaaaatatatcagaaaatttttttccacaaatggcttttttaggaaaaaaaattataattaacaggatcaaaatttcacatagttccacatctctaaacttatatagaantttaatgattacataacttcaaccatatcaggcaaatacacttcttttactaggcatggcatcaatatcctccccanttaaantactctggtaggnctgcctacagtatttcagnt

SEQ ID NO: 282 - DNA, 598 bp, Homo sapiens
tcaaaggtgattctttcagtatttattagtaaggctgaggcaacagcctttatacggcacagtttacataagttatcaagatacatcttgtatacaatcacaaaaccaagacatatttttacatagagtaaaactcaagacggatttacaagcatttttttttaaatgcaactctcatgtattttcaggtcaatttatacagtccttagtccaagaatttgcatttgtccattagattttccaaagggatttgggtaaaacaaacaaacaaaaaaacacattagcaaatcaccaacatggcatgcaacatatagttagaaacaagacatatcttcaagtactttagtttttatttcaaaatcagttttattaagatgtttatgttttcagacaagaaaattttttcttaaacctcatatgtgtttttaggatattagcacacacattaatcagtagtgggagcacctgagcacgtcaccaaacaaatatacagacacaatcaaacaataatcatattcacatgctaaatgccaaatgaaattaatatttcaacttcgtctactttaccaagtgtatacttatgtacaaggtaatgcat

SEQ ID NO: 283 - DNA, 2844 bp, Homo sapiens
tgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatgg

SEQ ID NO: 284 - DNA, 359 bp, Homo sapiens
  misc_feature (42)..(42): n is a, c, g or t.
  misc_feature (44)..(44): n is a, c, g or t.
  misc_feature (48)..(48): n is a, c, g or t.
  misc_feature (265)..(265): n is a, c, g or t.
  misc_feature (301)..(301): n is a, c, g or t.
  misc_feature (346)..(346): n is a, c, g or t.
  misc_feature (354)..(354): n is a, c, g or t.
ttttttttttttttgaggacctacatttaataaatcaaactntncttntttcatcagaatattcacagtttgcaacaggatcagcgcgttttctcacttgcagactcggaggtatttcaggagaaggcgacgtgagcgcaccattccgatgcttcattcttgaccctctctggggctttcaatgtgtcattgtgtcagatccctctccccttcaggttttcacggtgctcctcatgcctccgccctctgggatccctttgccgtnttccggtgtggaagctttggctgctggccggctggnttcggaaggagtccaggggagatttagggagctccccctgggatngccagggnctggg

SEQ ID NO: 285 - DNA, 259 bp, Homo sapiens
ttttctttttgctttgttggcttaatttaaaaaaacaaaaaggtcttatccagtgggaaatgtggttgaaattatctagcctgccacgactgaaaacgcacgttcctcctactctcacctttttctttcactccaaattcagtggctccagtcaccctctctgattctgtgggaactcatacaatgtctgtcccgaaggatacagggggcttcccagggagttccccatctgcgggcttgcctgtcgctttactccctg

SEQ ID NO: 286 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 287 - DNA, 175 bp, Homo sapiens
tttttttttttttttttttttttttttttttttttttcttaaaggctttcatttattgaaaaaaaaaaaaaatgcccccaaagccctttgctggtcatgaactgtttcaaaatgggggggtaataaaatgcacctgggtaaaaaaaaaaaaaaaaaaaaaaaagtttttttggcc

SEQ ID NO: 288 - DNA, 2612 bp, Homo sapiens
gctgatagcacagttctgtccagagaaggaaggcggaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcgttgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaattgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttcctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattatttttgctcatcaaaaaataaaggattttttttcacttgaaaaaaaaaaaaaaaaaaaaaaaaaaaaaaa

SEQ ID NO: 289 - DNA, 503 bp, Homo sapiens
ttttaatttatggaactagtgggatacatttatctcgcccgcactaattaactatccttaaatcacaatcttcgaaaggagtatctgccacatgcagtctggtaaactgcttttcataccttactcagtcctaagtatgtcaccatggacataactggtgctgccaatgcaaagaccagcaagtgctttctgattcgattccgctctaagccagcatgcatcaagaaggaaaccagtccaaaagcagctggtgccttatgtagcatgattgccacaaacacaattaactggacactggtctgtgaagtagatgctgctgctcccaaagcaacaccatcagctgcagcatggacaaccagacccagcgtggtggtgattttggaatagctagaccttgctgcttctggatcgtcagtagaatgcacatgggagataccaatctggttcaccagcaacatgaaaacgaagcccagaacgagggaaacaccaaaataggcatgcag

SEQ ID NO: 290 - DNA, 1429 bp, Homo sapiens
gccacgaaggccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 291 - DNA, 337 bp, Homo sapiens
  misc_feature (291)..(291): n is a, c, g or t.
  misc_feature (314)..(314): n is a, c, g or t.
actctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccagggccggcttcagctaataccaaggtttctgtgtgcataatagtttacagaggaacttaaggagtaaggactgcgggattaaaaacaaaactttttttaactttaaanttttagtttttgttcaagtaccnggggttattaaagtcaaatttct

SEQ ID NO: 292 - DNA, 427 bp, Homo sapiens
aacataactgtggacatataaacatttaataaatcagcacacaactgtgatggtgattgatcctttgacacgcacgctctgtgtggacgacacgtgctcccagcatggtaggggaatgacctacggggctgacttcggaactgaagactccccatatatgcacactgaacacttgcgtgcagacgctcccgaataccgcaggtcttagccaggcaggggtgaatggagggaacagagcagctccttccagcctctgggcaagcagagtgcttcctttttccagccccaggcatcgccttccctagacacggttttctctctgtgtgttctctcattctttccagcaacagcacagacagagctcagactggctgtgtgtggggtggcccacaagacagcgagcctgcttgcgctgccgttgtgctgt

SEQ ID NO: 293 - DNA, 1145 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtg

SEQ ID NO: 294 - DNA, 468 bp, Homo sapiens
  misc_feature (398)..(398): n is a, c, g or t.
  misc_feature (419)..(419): n is a, c, g or t.
tgttagtattaatatcatctgctactccaccagcaagaagaggcaaactcattctctcactggataaacaatccaccttcaagtctgtcttatttacaacatgattttcttcaattaaatctggtaatccaggacactgagcatcttctatgctgctcctcgctttcaggaatactcaaaaacaaagtcttcttcacatgttcacttttcgtattctgaggaccggcattttctggtgatgtagtttgttgtggaatgcccatctcatttctactctgagatacagctttgttgacagacttaggtgttccaagtctttgagaagggccttcagaagagacagaaagtcctgagaataatttaacaggactttcaactctggaaaaatccagcatcgnacactattttatcaacttccnttgggtatcacagaaactggcggtttcagcacattcttcccggcccaat

SEQ ID NO: 295 - DNA, 692 bp, Homo sapiens
ggcaggctgagggcaggtgggaagcaaacccggacgcatcgcagcagcagcagcagcagcagaagcagcagcagcagcctccgcagtccctccagagacatggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagccccaagatggtgcaagggtctggctgctttgggaggaagatggaccggatcagctcctccagtggcctgggctgcaaagtgctgaggcggcattaagaggaagtcctggctgcagacacctgcttctgattccacaaggggctttttcctcaaccctgtggccgcctttgaagtgactcatttttttaatgtatttatgtatttatttgattgttttatataagatggtttcttacctttgagcacaaaatttccacggtgaaataaagtcaacattataagct

SEQ ID NO: 296 - DNA, 416 bp, Homo sapiens
  misc_feature (292)..(292): n is a, c, g or t.
  misc_feature (358)..(358): n is a, c, g or t.
ttttttttttttttttttttttttatgcaaaaaatttattttcatcagtgaaatacaacccccatgaaagctcccacacaatctcagtaggctggtggtacagtgccttggaaagagaaatcaggagtgacattcaatagccagcaaccccagaaaaccctctatcttgatggaaagggctacttgttttctgtctcctcatcctcacatgtacattccatctgcctaatgctttcctctcttaattgaaaaacaaacaggacatgacacacacaaaaaaggcatttcttgnccccatttcttaggcaaggcaagggtcaacttatggccggcacttcgggctgtgttggtagggtgncgggaaaatgtttttgtggattttcttggaggcacagcttttttacacggtgtgggcc

SEQ ID NO: 297 - DNA, 207 bp, Homo sapiens
tttgtagagacagggtcttgctgtgttgctcaggctggtctcctggcctcaagagatcctccagcctcagccccacaaagcactgggattacaggcgttgagacatcgtgcctggcctggatgatattatttcagtgagctctctatgccagtcttcaatgtggggctcatcccacaaatatgtcatttctgattggtgttggaaag

SEQ ID NO: 298 - DNA, 353 bp, Homo sapiens
  misc_feature (5)..(5): n is a, c, g or t.
  misc_feature (224)..(224): n is a, c, g or t.
  misc_feature (348)..(348): n is a, c, g or t.
tttangtcttcaggctattgtgaaacatgtcctagctgttagcttacctctcctcattaagagctagaaatgtctaaaagcaaagcccaggaattctggagctttagaaggccctaggctaatttaaagcgacataccccatatgtgacagtcattttaaaatggctttgaggcacaactgacataaacgatacacacttaaatttggtgacttttgagcgaancattacaatctagaccccaaacatccccctgtaagtatcactgcccccattaaaatattttcatgtccaggcaatcggtgatctttcagttgctttattggtttgtaatttttagggattttcngtgtg

SEQ ID NO: 299 - DNA, 443 bp, Homo sapiens
tttttaaaaaagctttattgaaatgcaatttaccataaaatttacccacgtaaggtgtaagatttaatggtttttgtgtatttacagaattgtacaaccatcaccagaatcaattttagaacattttcaccaaccccaaaagaaaatctactgtttagatatcaccctccaatcctccccaacccctggctagcactaatctgctgtttctctatatatttgcccattttggatatttcacagaaatgggatcataataatatgtggtcttttgtgactggcatcttccagttagtataatgttttccggtttcatctatatagcagcacacagcagtacttcattctttttcttttttaaaattgaagtaaaattcatataaaattcaccattttaaagtgtataatttagtggcccgtagtacattcacaacgttgtacaa

SEQ ID NO: 300 - DNA, 454 bp, Homo sapiens
  misc_feature (127)..(127): n is a, c, g or t.
  misc_feature (162)..(162): n is a, c, g or t.
ttaatgtcgaaaatgcaaacttggggagggcagaaagatcacacacaaggctgtcacttcatacttgcaggattgcacagcagccgggcagaggcgctcctcacttcccagatggggcggcgggcancagagacgcacctcacttcctagacagtgcggcancatggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagctgttatgacg

SEQ ID NO: 301 - DNA, 607 bp, Homo sapiens
tttttgaaggagaaaggctttaatatatattaaaaataggcaaggtaatgcttttcatagtatagtaagatttgcctaataccatcttatttctttgattaaaagttacttagcttcagcatgcgtgtacattcaaaatacaaaattaaagcatgagttgtcattaatttgcagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctgcggcttggtgaaatttctgtctgcacaccactgaacaaaatattgtcttgcggcatacaaactctttctgtccaccttcttacaatatactcgaatcagctgctctgcaaatttctctggcagaagttgtgaaacctggtttttagtaatcctgattgctctgttgggggcagtcttacaatagaagctaacatgatcaattggattcttttcttgcattccata

SEQ ID NO: 302 - DNA, 509 bp, Homo sapiens
ttttttttttttttttttctctgggaacctcagttttttaatctataaaatggggaaatgttaatggtacttaatatttggagcttttgagtccattaaatcaggtaggattgttcgttattttttttttttaggaagactaaaaatatgttgctccctttttctcccccatcaagcttgatggggggaattggccctggagctgtttactgtcagttcctgtccagcttcactaaatttggtctggggtcacattttaacttggggactgtggggttctgtggtcccttctcgacttggcccagctccacttgaatgatattgttgtcaaattgctataatagaatccagttgatggacagactatccaatgaatccattatgttggtggtggagctggtgcaaagagctccagagcagctgttggcactgacccccctccaccaggcagccctggcagagagggcactacaaaacctggtaagagtccaccctaccagactcagatt

SEQ ID NO: 303 - DNA, 432 bp, Homo sapiens
  misc_feature (152)..(152): n is a, c, g or t.
  misc_feature (155)..(155): n is a, c, g or t.
  misc_feature (302)..(302): n is a, c, g or t.
  misc_feature (380)..(380): n is a, c, g or t.
  misc_feature (389)..(389): n is a, c, g or t.
  misc_feature (401)..(401): n is a, c, g or t.
ttactgaagaaaatgtactttattaaacagaaggctttctctcaaggccaagcccagtccccatgtgcagaaggagggtgtcagggtcacaggaacacctgcaaactggaagagaactcagtggtacttatgggccagggcaatggcgacanagnacaccagcttctgccagggcagcctgcacttcaggggtgaactccttgccaaagtgagtagccagaataatcaccatcacgttacccgggagcttgaagttctcaggatccacatggcagcttgtcacagtgcagcttcacttcagnttaggcaaagggcgggctttgagggttgtccatgttttttaataggcattttccaaaggggaggttcaggcacctttntttgacctnggggcttttganccttgggggtttgcccggggttggccagagg

SEQ ID NO: 304 - DNA, 435 bp, Homo sapiens
  misc_feature (2)..(2): n is a, c, g or t.
tntttagaaaagctgttctttaatgaagaggaaatgatataccatgggtatcaaatgttcttttctgataaaggaagcaactacagaaagcttttatttatttgttcaaagtaaccagtgctatggatgcaaaaaacccccaacaactcttccaacgctactttcaaaacaaacatatcaaacttgattttcattaggatgtagttattttgtcacactagtaaatcaaaatctaagacccaatttttatatatatatataaatatatataaaagaacaatgtgaacaattattgagcttcatcttctcggacaagaatgccaagttagtctctcttcataaaaagcaattacaatttcgaggacacttcatatttgcctctttcgccagcaccaagtctgcctcatctgaatctttccatttcatgagaaacat

SEQ ID NO: 305 - DNA, 481 bp, Homo sapiens
  misc_feature (42)..(42): n is a, c, g or t.
  misc_feature (450)..(450): n is a, c, g or t.
  misc_feature (465)..(465): n is a, c, g or t.
gagttttgctcttcttgcctaggctggagtgcagtggcagantctcagctcactgcaacctccacctcccagattcaagtgattctccggcctcagcctcctgagtagttgggactacaggtgtgcgctaccacgcccggctaatttttgtatttttagtagagatgggggtttcaccatgttggccaggctggtctcaaacttctgacctcaggtgatctgcccgcctcagcctcccaaagtgctgggattacaggcatgagccacgttgccagccattttctttgatattctatgcactaagtaaattactaaatctaatcctaaattattggcttatcaataaatttttggggactatcctccccactccaaaataaaataatactttccgtagtgggtttttggattacaagaaacatccttggcaagtaaaaaaagtaacatttngataatccttggaantgggagggaaatactt

SEQ ID NO: 306 - DNA, 427 bp, Homo sapiens
ctgtcatgaagtgttttattttctgcaaaatgattttgttttatttaggagtggtatgctgcttaagatggaaaaatacatgatgatggtgcatagtgcctccatcccaagcttgctaacattaacccttttgtcggcattatccagctttccatatgttcttttttaagttttattttattttattttaagttctggggtacacatgccagatgtgcaggtttgttacataggtaaacgtgtgccatggtggtttgctgcacctatcaatccatcagctaggtattaagaccggcatgcgttactatttttcctaatgctctccccactgccctcccccaataggccccagtgtgtgttgttccccctccctgtgctccctggtatccatatcatgaaatattttaaagccacaggaaaaaaaaaa

SEQ ID NO: 307 - DNA, 1201 bp, Homo sapiens
gccattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaaaaaaaaaaaaaaa

SEQ ID NO: 308 - DNA, 482 bp, Homo sapiens
  misc_feature (379)..(379): n is a, c, g or t.
ttgactaaagcaacttttttatttacagtataaaggttacaaaggtatatatgtatttatatatataatacccttaagttacacattttcattgtaatgtacaatgctgtatgttgatgtgctactcaaggggaagtgttgtttatgcatctatatttatagagtatacataaagctttttaaaattaggaacacaaatactgccctgttttacgcgttgggtttttgatttggtatccagaagatctgagacttaaatttcaaacaagacttaaaaagaaggcttgtttaaatacagggttctaaaaagaaggaaaaaacccagaacatcacatacttttaattatttgtaaaagcattattctagttttctaagtcnttatacttaaaaatgaaagcagtgtgggaaaagaatccacataagcagggtatcatcagagtttgcacagattagccaaaacaggccttccataggtagtggg

SEQ ID NO: 309 - DNA, 5580 bp, Homo sapiens
agctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcccctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtggataagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaac

SEQ ID NO: 310 - DNA, 469 bp, Homo sapiens
tcttttttcccccttgaactgctactgtttggggcatcgggggagggtggctgcagcgttccaactcctacaattccaagatttctaacacagaaaacccgttaaatctgaagtttagtttgagcctggatggctgtgaagagctctaacagctaaaaccatcaccaaagaggcctcaaagtgcaatctacgcaagggtgtgggtttggtggcgggaggaaggcagcagaacgattcatttgcaaataaaagggtaaacaattctgaggggaaaggggcaaattcattttcaccaccactcacctctcggcggcaaacggaacctgatacttttttttttcttaaggctcatcttctcgggttaccaactctgggaactaagcggctaaccaggtccacacaggggtagtggcgacgcctacgtctccctcccccacctgtgcacccataccagaaagccaggctctac

SEQ ID NO: 311 - DNA, 459 bp, Homo sapiens
caagcaaggctttccattccattcatttatttattcatcccggagtgctgggattaaaggcaagagccaccactcctggcgcaaggattccgtgtatatatatagaaatacatgtgtacagtgaaaggaaataaaaatggacaagaaggaagtcgagacccctgcagccgttattttttgggcaatagggaattcggtggttcttttggcctttggttttctgggttttctgagctagatttaaccatgctgaaaggctcttgatacacgaagttgccaggcctcaggattctcagagttaaaaccagcattgaatgggaatgtttgaaaacctcactgcagagccaagcctcccatgtgcaatttgcattttccctgtggaagcctgcggttccctgtaggaagccgcctcccttctccttgaagtctcctaggtctcagtttctgcatccacccaat

SEQ ID NO: 312 - DNA, 457 bp, Homo sapiens
gcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaaggcacacaccaaggctgccggggaggcccgggcaccggacagatgcctgttgggaagccaggagctgccgagccacggaccacctaacagcctctccgcccggaacgtgacatagagagtgttggcattaactcggggggtgtccgatttcacttcagacaccaagtttttctttgtttgtttaaacatggaattcagacttcattgtaca

SEQ ID NO: 313 - DNA, 187 bp, Homo sapiens
tttgtaaatggcaaaaaatttaatctcatctgtagtcctccttaggaaaatctaatgtaaccaaattcccaaatcccattctgaggctctccatgtcaaaagtttcaatctctcgctcttgcctttccaataggttctttattctctcgctgcggtccttctgaagggcagccagcttctcttcaat

SEQ ID NO: 314 - DNA, 2121 bp, Homo sapiens
gagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattaaaaaaaaaaaaaaaaaa

SEQ ID NO: 315 - DNA, 605 bp, Homo sapiens
  misc_feature (437)..(437): n is a, c, g or t.
tttttttttttttttaaggtgataagaatgtttaatttacttttcatagttcatattttctgaatttttataacagcatatatcactgacaaaatattgaaaccatactttaaaaaataaattcagaaattgttttaacaaaataagcaggaaatatataaaagcaggtaataaaagtcatcaacgtacacagtgtcttaataaaagtcagcagttggagtagaaattactattctaaggtttccagaaaaacctaaattagcttatgaattgctatatttagaaagaatatgaaacagaatatcagcaatgtcattgcaacattgtctgcaatacattaaatcagtttaattgttccttaggcatctgatctaagaaatttttcagaggtgctaagtcaactttaagttaaattatgaccaataagagaaacattntaactaatctttatatttttagaagacttatatataaatccatcttgtgatgtagagtatttcttgctttagagtattatttcaaattccttcaactaaaaataatgactataatttaagatgatcataggatgtgatctggcattgattcattttatcagtccattg

SEQ ID NO: 316 - DNA, 2749 bp, Homo sapiens
gagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtacagccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctcccca

SEQ ID NO: 317 - DNA, 2120 bp, Homo sapiens
gctgcccgggctgcgcggcgtctgcaggcgccaccgctgcctctttccggctgtgaccctcctcgccggcgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaacagggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaaaaaaaaaaaaaaa

SEQ ID NO: 318 - DNA, 630 bp, Homo sapiens
gcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctctttttcagcca

SEQ ID NO: 319 - DNA, 495 bp, Homo sapiens
ttttatgatcaaattttattgtttattttataaaaacagtacacagtgaaacaaaagaaaattattcttctctcagaaagtaacgagtaggtcagccttactgttaagaggataagtagacatcatataagcttgcagcttacaaggtacatgttagcctgccacagtttctttgcatcttctcatgaaaccacaagaatacaggattgttccaaccacagacgtgagtttactgttttcttgtttttgctttgccaggccaaagtcagtaacggttactttgtccttatcccccaacataatgttgtttggtgtcagatctctatggacaatcctcttctccttgtgtaagtatcgaagagctaagcacagctgtataaatattttccatagtctttcttcagtaaaatggggatgtttttccttcaaagaactgaaatgctctccaagcggggctccttctatcagctccataactatgtacaacctatcatt

SEQ ID NO: 320 - DNA, 1762 bp, Homo sapiens
acacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 321 - DNA, 7033 bp, Homo sapiens
cacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacctaaaaaaaaaaaaaaaaaaaaaaaaaaaaaaaaaaaaa

SEQ ID NO: 322 - DNA, 1066 bp, Homo sapiens
cacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatg

SEQ ID NO: 323 - DNA, 479 bp, Homo sapiens
tttttttgagatggggtctcgctctgtcgcccaggctggagtgcgtgcagtggcacaatctcggctcacggcaaactctgcctcccagataccacacaaggacttctccgagccagctttctgagggttaactgagggctgaggggttcaagaaggaggacacgggcacagggactcacgggcagtgagaggcagtggggccaatggcgtgaggagcaccagagagcaggagggaacgggcccggggcgtgaatccggccccatgagtgctcttcggccgcccaaaaccggtcccatgggtaacagcgtggccttcggcaagtgactaaagggcttcctgcctcagcttccccacctgtaaacagaggataacaatggcatgtactggatctggcataaagtaaatgttcaatagatagctagaaaagaatgttttaaaacctcagagatacattaggcgaaaataaaagctgggctac

SEQ ID NO: 324 - DNA, 421 bp, Homo sapiens
  misc_feature (307)..(307): n is a, c, g or t.
ttttttttttccgagctgtcactgggctcctgacctgcccctgaactccaccctgccaggcagccaacagacaagctctctctaattgacccaggcaagagaggggagggattggaggagaaagctgggataggcaggccctggaaaggtcacctacctgctggctccaggccagtcttgaaggtgccaggggttctggcccagtgcagcccacaggcccccagcagcccatgcactccaggctctgaccacaaggccagtctagagggatgtgtgtgggcagagtgaaggggcaggggtggagcanagcatggatgcatagaacaagaaagaacaaggacactgcagtcccattgccctgggagtcagccccagcttcatggctcctggggacctcagagaacattgatagaagatccta

SEQ ID NO: 325 - DNA, 211 bp, Homo sapiens
ttttttttttttttcaggagactttacagtttaataaaccattcaacctggagaaagggaggtcgggacttaggtggcggtggactaaggacatgacaggagccataggttgtcagggagctggagcccaaggtacaggatgggaaggctttgctatggatcccagcctttctagggctgggtagtgggaacctcccaaaattggagttcg

SEQ ID NO: 326 - DNA, 775 bp, Homo sapiens
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagatgctcttttaaaaggt

SEQ ID NO: 327 - DNA, 157 bp, Homo sapiens
tttttttttttttttttttttttttttttttttttttttttttttttttttttttttttttttttttaaaaaaattttaataaaaaaggggaaaaaggtgggaatagcggggtaagggcgatgaggcccttccaaagccaaaaaaaaaaagtttttt

SEQ ID NO: 328 - DNA, 486 bp, Homo sapiens
ttcagagacaatttttattttaaagaaaaagtaacttatatatttttaaaatctagagaatgtacaactcctctgccacaacgtgagggagagaagtctgcagacggctgactggtgacgactgaacaagacggaaaggcaagtcgctatgcccgaagcctttgaagggagccagcagggtccatgggaggttcaggacacatatctgcagccctgcttctggccccacccttggggaagccttttgcaggtgatcctgggcctctgctggggaaggccccaagaggtgaagcatcctggagtgaaaagcagttgagtagaaacagagagtggtctgtaatttccttctggaaggaatatccactccatatggcctgaagcaagaatttcaaactcctctgtctggaccacatcagggactcccttcccctctggtctctggttgggtgtggccaatgagggaaggaaatggagtgagggtagact

SEQ ID NO: 329 - DNA, 394 bp, Homo sapiens
tttctattttgaattatttattctttcaggttccaactgctaataaaggagtacatcttctctttggggtataacaggagggactcagtaaagtagtttggaaaggacatggtttagctaagccatcctgtggttttgaaaaggaagcttcgagtgaccgtagcagtcaaagtacgtacagaagtcacaagaattcatccacaactttagatttgaaaaacaatctaaatgttaggatttggaaaaagcagtatgaattttaggatcttcgaataaaactgggaagacacaaacttcaatccatgttacagaaaattggagattttgtcatcaaattgttccttgggtacatttttttcccttaaaaatgcaaccttcatctcctgaagttgag

SEQ ID NO: 330 - DNA, 1723 bp, Homo sapiens
tgctacccgcgcccgggcttctggggtgttccccaaccacggcccagccctgccacaccccccgcccccggcctccgcagctcggcatgggcgcgggggtgctcgtcctgggcgcctccgagcccggtaacctgtcgtcggccgcaccgctccccgacggcgcggccaccgcggcgcggctgctggtgcccgcgtcgccgcccgcctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccgctgggagtacggctccttcttctgcgagctgtggacctcagtggacgtgctgtgcgtgacggccagcatcgagaccctgtgtgtcattgccctggaccgctacctcgccatcacctcgcccttccgctaccagagcctgctgacgcgcgcgcgggcgcggggcctcgtgtgcaccgtgtgggccatctcggccctggtgtccttcctgcccatcctcatgcactggtggcgggcggagagcgacgaggcgcgccgctgctacaacgaccccaagtgctgcgacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctacgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagccgtgccgccccggcttcgcctcggaatccaaggtgtagggcccggcgcggggcgcggactccgggcacggcttcccaggggaacgaggagatctgtgtttacttaagaccgatagcaggtgaactcgaagcccacaatcctcgtctgaatcatccgaggcaaagagaaaagccacggaccgttgcacaaaaaggaaagtttgggaagggatgggagagtggcttgctgatgttccttgttg

SEQ ID NO: 331 - DNA, 1752 bp, Homo sapiens
cgggggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgcggggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgttgctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatattcacaaacgtccccactcccaaaagtaactatattctggatttcaacttttcttctaattgtgaatccttccgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacagatttttaaaaataaaattgtataaaacattaaaaaaaaaaaaaaaaaaaaaaaaa

SEQ ID NO: 332 - DNA, 433 bp, Homo sapiens
  misc_feature (433)..(433): n is a, c, g or t.
agcagcctgccaaaaatattattagaaagctttgttgccgctacataactttaaatctctccttcctcagaaaaagcacccataaaactcagattgatttatgaacagtagcataagggctaccgccagcgtacctgccctgttgccgcctgagaagtgggggcttcttggagaactctttcagatccccggggaaagtggcagagtctaccgaaaccatttatagagaagtatccagactgaagttctcagttccaggaactagggagtacccattggttgatcaccacagtgactctccaacagttcaccctcaagagcgtgacagagtgatcctgttttctgaaccaaaattcaccatgcctgcctgaaagaaacaacattcaaaactggacaccatcctgggaaatgcagaatatatggtggctttggn

SEQ ID NO: 333 - DNA, 382 bp, Homo sapiens
ttgattttttaattaaaatttatttaattttaaatgttctttccaacggaagaggtaggtatatttccacatatgaaaaatcaggaacagccataaatcaaaacaaggaaagcctgataaaaatcaacatattctaacagcacataaatgtaactatcttatgatgttactaataaagacatgagttgtttcatgtttcaatcagacaataatcttaattttcataatatatttctgctactaacaggagtattcaaatgctgccttttcattacaaaaaattgtttccccacagtgatttgtgcctcaagtcatggtgatctctgggtcaccagacaagactttactgcaattctttcttattttcaccaacaccatcatc

SEQ ID NO: 334 - DNA, 281 bp, Homo sapiens
ttgctttttaatcacactttatttaaatgcacaaatgaaggctgtgaggctggcttctctgccttccttctccctaggtttccctctgggatggtaattaggaaatacaacccaatataggaaatgagcattgttgcttttatgaggattttaaaccaaatggctttgctacggtagcggaaggagcttctcgccctcagaaacccagcaggttgttccaggttacttggtacttcttgccttttggaaaatggctccttggcctcctgcaaggcattcct

SEQ ID NO: 335 - DNA, 3752 bp, Homo sapiens
ggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgaaaaaaaaaa

SEQ ID NO: 336 - DNA, 358 bp, Homo sapiens
ttttcaggaaagcttgctgttgtgagggattcccattccatgaggtaatatccagtaattcaactgtattaattttagaaactttcttaaaagtttaaatctcagtttctattttcttttttcttgctaggttattcaagaattccttttaaacaaggataaattggtgaaggttatcaggtaccaaagacctgatttgttattgtttcaggtatctgaaaataaattcttctttactgtatgaagttatatgctggaaagataggaacagatattcactctgattggtctgagaggaggtttaaaattaaaacaggcagctcttatattttttcagcatttatttctactctctcat

SEQ ID NO: 337 - DNA, 563 bp, Homo sapiens
aattcaataaaacttttaatctcaaagatttttatcagactccagaagttcatggcaacagatgcatgacctgcatttcttaagaagattgggtttgagatcctgctggtgacaggagactccctctcatcccccagtacctgcagccagtcgagcatcctggcaatgctgtgtcccaccaccctggtattattgaccgcatccgtgtaaagctggtgggccagggggagccagtcaaccacaactacattggcgtctttctctcttgtgtgcagggctgacacgagtttgtgcagccagttttcaaagataccgctcatcgtccatccgtgaatgatgaaaaaggttttagctgtcatgttgaaactgcagtcttctaagggctggctgtggccgacggagaggtagcatccttcatgctctgggtccttggaggtgcggaggttaaacctcacagatggtttgacctcagtctgtgtagctttgggtttgtggagcttatcttccagccgtccctctggaccaaaaggtacggggctccccgcagcaaagcaatagcagag

SEQ ID NO: 338 - DNA, 336 bp, Homo sapiens
tttgaatttttgattatgctttaatagggaggtaaggaaaatgtatacaggatttgggaactagacaacgtgagtttgcatttgggctctagcattatgatctctctgaccttgggcaagtcacttcacctctgagtgtgtttcctcttctataaaatggggttgataagttgcccaacccgccctcacagagctgttgttggaattgaatgagataaagtatgtgaacacgtttcacctatgtaactatgtgcagatgctcattactgccatggctagggagagaggtgccggagcagaggtgagcagctgcctagaggaacttgagcaggtttc

SEQ ID NO: 339 - DNA, 1645 bp, Homo sapiens
agtctctcgtcatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataacgcccagcctgggtgcagcccacctggacagagtccgaatcctactccatccttcatggagacccctggtgctgggtccctgctgctttctctacctcaaggggcttggcaggggtccctgctgctgacctccccttgaggaccctcctcacccactccttccccaagttggaccttgatatttattctgagcctgagctcagataatatattatatatattatatatatatatatatttctatttaaagaggatcctgagtttgtgaatggacttttttagaggagttgttttggggggggggtcttcgacattgccgaggctggtcttgaactcctggacttagacgatcctcctgcctcagcctcccaagcaactgggattcatcctttctattaattcattgtacttatttgcctatttgtgtgtattgagcatctgtaatgtgccagcattgtgcccaggctagggggctatagaaacatctagaaatagactgaaagaaaatctgagttatggtaatacgtgaggaatttaaagactcatccccagcctccacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcctcaaaaaaaaaaaaaaaa

SEQ ID NO: 340 - DNA, 987 bp, Homo sapiens
ggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcgacctttcctgggagttctaccaggagcatcaggaaggttgagctgggtgtatgggaaccaggccggggcgaggggttccggggggacctgagaacattgtgtggagccctggatccaactgtacctgacactagccaatttcatttcttcagtttcatggacccctaaattatgatttttgc

SEQ ID NO: 341 - DNA, 2682 bp, Homo sapiens
attcctgcgccgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcttttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcatgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccggtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccatgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccgtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatatctgtcatgcactattttcagttgacaatttctgtattttaattgaatactgtttcttcagtcatggttattattgcactttatcctgaataatagttcagaaattgggttttggttcagtgattctcaagaaaaagatctcttgcccattaagaagtgtatcaaaatctcataaggaatgagggagagaagggggctgtacagtttgaaaaagcatattcaatattaaaatagttttatatttgggaaggcaaaaatgaatctattgttttgcaatataggttatacaggaaaatgcaataaaatatatatctggttgt

SEQ ID NO: 342 - DNA, 407 bp, Homo sapiens
gtttagagacagggttcactctgtggcccaggctggagtgcagtagtgcgatcacagctcactgcagcagccttgatcttcagggatcaagtgatcctcctgcctcagcctcttgagtagctgggaccaaaggtgtacaccaccatgcccagctcatttttaaatttctgtagacatggggagtctcactatgttgcccaggctggtcttgaactcctgggctcaagtgttccatctgcctcagcctcccaaactgctggaattacaggcatgaccaccaagtccagcccttcttgctctcgtttttaaaatggtgggtgacttccaccctgagaagggatgtgaacactatggtgaaaacttatttcctatgaagtttactctgggaaaaagagagagaaagaaag

SEQ ID NO: 343 - DNA, 373 bp, Homo sapiens
tttttttttttttttttttttttttttttttttggccaactgtgatgacctttataaagtgagccatgcctaaaaacactgtaacaaggtctttggtaaacatatacaatgcacacatgcacgtagagatccaagctatttacatgacatctgttcacttagcgcttcatagatcattgtccacttcatagtcttggctctggaactagccctagcaagacttagtagcaggtgaaggcaccactttgttggatgtcacatgaatgtggtgaggtggctgacagcatagattctgatgccaaacagaactagtttgtcttccaggtctgccactcactagctgggtgtctgtgggtgaattacttcatacttc

SEQ ID NO: 344 - DNA, 443 bp, Homo sapiens
ttttgctgttattcatattatattgattattctgccccagcctgtgagccgtgtcaactcttagaggaacagcaatagagcacaggaatggcacatagaacatgggctctgagcacaaaaacgagctgtgtaactcaagttatttaaactctctctgcctcatttgcctcatctgcatactggggttactaacagaccctacctcatggagtttgggaggattaaatgagttcatccgtataaagctgttagtacggcgtctggcacctggtaagggcccagatgtccactgctgtagtgtattgcagtagattgtttccaaaggtggctgcaacaatttgtcccattgaaatatgaagagacagagtctgtttccttccccttgaatcttggctggccctatgacttgtggaagaagtgacgttctgggacttctgggccat

SEQ ID NO: 345 - DNA, 388 bp, Homo sapiens
  misc_feature (350)..(350): n is a, c, g or t.
  misc_feature (377)..(377): n is a, c, g or t.
aaagctcaagagctaaagtcagagagtggagcccagattcagagactggccttgctgactctgaagaccctgtttggtccccaagacttcattccgtcaccttcacttctatcccagatcctctcatttgtttccacgtatcttctgtgattttagtttgcgcaactaaacctattctgagtttttatttaaaaagataccctctctgatttaagaagaggcataggagacacaatcctattgggtgcctactgggtcacagtttcacaattcaatactggcaacggcatcgtaattcaaaggcattgctgggcttggggtaattcactttcattaacaggtccccgccnggcataaaatacaagggcaatgggggnattaaaccaat

SEQ ID NO: 346 - DNA, 441 bp, Homo sapiens
  misc_feature (419)..(419): n is a, c, g or t.
agatggagtctgctctgtcacccaggctggagtgcagtggtgcgacctcagctcaccgcaacctccacctcccaggtccaagcaactctcccgcctcagcctcccgagcagctgggaccacaggcatgtgccaccacacccagctaatttttgtactctcagaagagacgaggttcgccatgttggacaggctggtcccgaactcccaatcccaggtgatccgcctgcctcggcctcccaaagtgcagggaccagaggcgtgaaccaccatgcctggctggaaaatactgttaagtaacagcagtaagagccgtgaaaatctaaagacaactggaaccagggagaaggcagcaaaggagtcccaaggctctggccactcctttagccacaccataaaggctttcctgattctgcccttntgctgagccttaggtccccact

SEQ ID NO: 347 - DNA, 414 bp, Homo sapiens
  misc_feature (184)..(184): n is a, c, g or t.
  misc_feature (228)..(228): n is a, c, g or t.
  misc_feature (303)..(303): n is a, c, g or t.
  misc_feature (319)..(319): n is a, c, g or t.
  misc_feature (372)..(372): n is a, c, g or t.
  misc_feature (389)..(389): n is a, c, g or t.
  misc_feature (395)..(395): n is a, c, g or t.
  misc_feature (410)..(410): n is a, c, g or t.
ttttttttttttttataggcatatatatatatatatatatttatgtatttataacatagaaaattggatagaaattattccaggcatatgggatgtggttcccctgggccagaaccacgtagggcagaggagccctgccctccaagtgtgcatgcccaccaaagggacaggggctttcagggantcacaccagatcacgcttgggacctttttagagcctggctgagncaccctttccagagttccagtgagcagggggcccctcagtgcatcttccccacctcccctgtcttccagggacgntgggctgcagacttcncagctgctgccacatggggttggagcctccaacagcatcatccctgagttagnacctgggtccactgagnccccanaggttcggctttatngcag

SEQ ID NO: 348 - DNA, 2500 bp, Homo sapiens
ctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccggtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 349 - DNA, 1493 bp, Homo sapiens
ttcctttcatgttcagcatttctactccttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagggcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccagcaattaaatggatttctaggaaaagctaccttaagaaaggctggttaccatcggagtttacaaagtgctttcacgttcttacttgttgtattatacattcatgcatttctaggctagagaaccttctagatttgatgcttacaactattctgttgtgactatgagaacatttctgtctctagaagttatctgtctgtattgatctttatgctatattactatctgtggttacagtggagacattgacattattactggagtcaagcccttataagtcaaaagcatctatgtgtcgtaaagcattcctcaaacattttttcatgcaaatacacacttctttccccaaatatcatgtagcacatcaatatgtagggaaacattcttatgcatcatttggtttgttttataaccaattcattaaatgtaattcataaaatgtactatgaaaaaaattatacgctatgggatactggcaacagtgcacatatttcataaccaaattagcagcaccggtcttaatttgatgtttttcaacttttattcattgagatgttttgaagcaattaggatatgtgtgtttactgtactttttgttttgatccgtttgtataaatgatagcaatatcttggacacatttgaaatacaaaatgtttttgtctaccaaagaaaaatgttgaaaaataagcaaatgtatacctagcaatcacttttactttttgtaattctgtctcttagaaaaatacataatctaatcaatttctttgttcatgcctatatactgtaaaatttaggtatactcaagactagtttaaagaatcaaagtcatttttttctctaataaactaccacaacctttcttttttaaaaaaaaaaa

SEQ ID NO: 350 - DNA, 402 bp, Homo sapiens
  misc_feature (341)..(341): n is a, c, g or t.
taacctctgcatttttgaacgtcctttttttagggtcttaattgaccattcttctttgattcacatcatctttatgttgcccacactccaattctctgcctacttactcagttgtaatcacaatccagtcctgccttcctcaagtttcactggctcaccatggtagcaattcgtgtgtggtcccaaattcttccaagcgtccactacatcctgccccacctgggagctgacctcactcttcctgtatgggcttgactagttaatccacagaaacagccatgtttccctaatggtcaagttcttgggcagccttcatagacactatctatctatctatctgnctatttatttatttatttattttttaagacggagtcttgctctgtcacccaggctggagtg

SEQ ID NO: 351 - DNA, 442 bp, Homo sapiens
cattactactagctttattccagactttaactccagactttattcatattttttaatttattatttacttatttagttcttgagataggatcttgctctgtgacccaggctgaatgtagtgatgcaatcacagctcactgcggcctccacttcccaggctcaggcaattctcccacctcagcctcccaagtagctggcagtacagacgtgtgccaccatgcccagctaattttttattttttgtagagacggggtctccctgtgttgcccaggctggtctcaaactcctgggctcaatccgtcctcctgtctcggcttcccaaagtgttgggattataggcgtgaaccactgtgccctgcctttatcctatttcactagtttttatactaataccctattctggttgcagaatccaatccaggataccacaatgggcattta

SEQ ID NO: 352 - DNA, 442 bp, Homo sapiens
ttataattggaaaatgtttatttttttccaattttattttacattcagtgggtacatacgcaagggggatggggaaaatagcgatttgaaatatgctattgtgaacgatgctgcaatgaacaaaagggtgtatgtgtctttttggtagaacacttcatttttcttttggtaggtaaaccaaaaagtatctgagaagagcgtcaatcaatttagaggtttactttgccaaagttaaaaattataacccacaggagggcctgagaacatgtgcccacaatggttgtgggtaatagcatgatgctgaggttgaaagtatgaagaatccatcaaccaggtagtgattatagtatccaatagttagtcttcttacaacccttaacccctgccatgtccccttggattccccagagtgtattgtttccatctttaaaaccatgtatac

SEQ ID NO: 353 - DNA, 3206 bp, Homo sapiens
ctggtgactcgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacagagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaaaaaaaaaaaaaaaaaaaa

SEQ ID NO: 354 - DNA, 462 bp, Homo sapiens
ttttttttttttttttcaagtgaaggtttgcttttgttattgttctttgattacatgaaaaattaaacatctgatttttttttcatacaaactcaatgtaaaatatgagtttgaccttggtagaaatgatccgctcaaagggaaagacattttcctctggattgcagagagtggcatcttctacaagctcctcccaggtatctttagctgaggctgtttgtaaaaggtgagggtgggtgttaacctttatatgcagtaacttcctgtctttctgaatctccatgactttttttaatctctagagctggctacagttcagtctcctcattcagtcatctgtccaacaattcctactggagttgtactatgggtcaggtcagtggatatgcagtgagcaaggctatacctttgtgtttctcgtgaagcctgctagtcccagcttctcctcctcaactgtgaaac

SEQ ID NO: 355 - DNA, 5480 bp, Homo sapiens
tatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaaaaaaaaaaaaaaaaaa

SEQ ID NO: 356 - DNA, 2922 bp, Homo sapiens
tgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgcggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgcgatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaagg

SEQ ID NO: 357 - DNA, 1866 bp, Homo sapiens
gggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttccccgtaaaaaaaaaaaaaa

SEQ ID NO: 358 - DNA, 1802 bp, Homo sapiens
cattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtc

SEQ ID NO: 359 - DNA, 3463 bp, Homo sapiens
tgcaaacgttcccaaatcttcccagtcggcttgcagagactccttgctcccaggagataaccaggtaaaggagtatgaaagtttgggtacaaactcattgctgcaaattgaaaaccatgcaaaggctgtcttcctctggggagttcaatgcctctctttttcttatcactttaccattggttggactttgattccagggatcctacgattactcaataccctacaggatatacatggttaaccatttgcatttgggcaaataggcgttacttttcaataggaagtggcaatccagaacttgcttttgggcaattctagtagctcaccgcttttttcttaatgactgctagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaaaaggaaagaactgtcatgtaaacataccgacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaa

SEQ ID NO: 360 - DNA, 600 bp, Homo sapiens
tttttttttttagtaggtaatacatgtttttattcaaaaataaattgtgcatctaatgtctaccaattaatgtacttgtagatgtatcatcttaacttgagtctttgttgcccctaatggggcatgaaggactcttctcccatggggaagtttttctttttcaggagggaggagggctttcccaagtaatgtgtctagagtgttgggcagaagaatctgggaccacaccacaccagttctctccttaacccacgtcattttgcctctatcccagctgtgtttccagtgtcctctgggtgtttccaagagcaacaggaaacgaataaatctctggtgagttgtttatttgttcttcactttgttttacactgtattttctgagtttattggtgtttggtttagaaacccactgggaaatagaccagtgagatttgaaaaggtggaacaaggacttgagtagaatatatcttcttatgctggaacatcctcagtcaagtagttctggcaattatttgaagtctgaggcttgaagtaggaattcttacgggcatttggggaatatattttcattgagtcctatactagtaagattttcaacac

SEQ ID NO: 361 - DNA, 3215 bp, Homo sapiens
cttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctagggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccaaaaaaaaaaaaaaaaaaa

SEQ ID NO: 362 - DNA, 468 bp, Homo sapiens
ttcagcagtaggtgcagctttatttaatctctttattcacatgcaagatggatgggagacgtggataacagaagtgaacatcactgtctcaggagagtgggtctgggagcctggacccgagagctctgaggcctccggagagcaagtgggaggagagggggcgctgggtgctgcatgcacacgagtagacaggagccagagaccagatgtgccatgagcaggggggttgtgggagagaagtgaggcatggcagggcctgggccagggcgtcacagccaggctggtttcccctgagagtgtcagggagagacattttggggtttggaaggaggggacccctaggaccaaaaggaaactggaagctcgccctgctcggcttcctgcctggagcctccatgctgtcccgagaacccgatgcccacatctgttagctgccaatgtcccaccctccagtctggacagagttgg

SEQ ID NO: 363 - DNA, 2963 bp, Homo sapiens
gtgagaagcctcctggcagacactggagccacgatgaagcccccaaggcctgtccgtacctgcagcaaagttctcgtcctgctttcactgctggccatccaccagaccactactgccgaaaagaatggcatcgacatctacagcctcaccgtggactccagggtctcatcccgatttgcccacacggtcgtcaccagccgagtggtcaatagggccaatacggtacaggaggccaccttccagatggagctgcccaagaaagccttcatcaccaacttctccatgaacatcgatggcatgacctacccagggatcatcaaggagaaggctgaagcccaggcacagtacagcgcagcagtggccaagggaaagaacgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgacgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctggg

SEQ ID NO: 364 - DNA, 5349 bp, Homo sapiens
ctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaa

SEQ ID NO: 365 - DNA, 506 bp, Homo sapiens
  misc_feature (454)..(454): n is a, c, g or t.
  misc_feature (480)..(480): n is a, c, g or t.
  misc_feature (487)..(487): n is a, c, g or t.
  misc_feature (493)..(493): n is a, c, g or t.
ttgaggttataaacattaacttgatttaatcattttacaacataaacatatatcaaaatattacactgtagacagatatatacaactattatttttcaattaaaaatagaatttttttaaaatttaatttttctttttcaatgaatctttgatttcttcactttaaactcttaggtattaagcatacaaatgtttaatggcttagaatagttacctaacacattatatgagccaaatactaactactcctccaaactatcttttttcatagcattcttcaaatacaagattattctgtatatcttattaaaatttatttgtctgccttatctaaatattgataaaaatagaaggtaggggcatttgcctggcttcatacattccaaaatcaaagggcagttttactaattatttttacattcagtaactcatttggtctcacacagtaaacacnaatattacgtaacaggactatattcntattccncatccnaaaaatgggaaaa

SEQ ID NO: 366 - DNA, 1407 bp, Homo sapiens
gtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctg

SEQ ID NO: 367 - DNA, 491 bp, Homo sapiens
  misc_feature (17)..(17): n is a, c, g or t.
  misc_feature (63)..(63): n is a, c, g or t.
  misc_feature (170)..(170): n is a, c, g or t.
  misc_feature (175)..(175): n is a, c, g or t.
  misc_feature (205)..(205): n is a, c, g or t.
  misc_feature (213)..(213): n is a, c, g or t.
  misc_feature (342)..(342): n is a, c, g or t.
  misc_feature (368)..(368): n is a, c, g or t.
  misc_feature (374)..(374): n is a, c, g or t.
  misc_feature (400)..(400): n is a, c, g or t.
  misc_feature (434)..(434): n is a, c, g or t.
  misc_feature (459)..(459): n is a, c, g or t.
  misc_feature (473)..(473): n is a, c, g or t.
  misc_feature (486)..(486): n is a, c, g or t.
ttgttttttcttcgccncttctcgtttttctttgtgaacatggactgttttcaccattgtaanaaacatctactttctcttgtaggattttccgagctagctttctgttctgatcaactgatcttgtctgatggcactttacaacgatgcctgaggggatgtgcttcaanaccancgcagttgctggttttgttggttgcctggncccctggncccgtgtcctttcacaaactgctcttcgagttcattctcatccaaggaaagcagtgcaggggtaggcccttcttgccctgccaatctgggacccgagttacaagctattcctggggggataacaaccgncagcttttttcccaaagccgggagtncccatnggggcccgggaataattcggggtcantgggttagggggaaaatgaaataaacccacgggngcttaaaaggggacctggggtcttnttgggcttaggacncggggtttaaggncccca

SEQ ID NO: 368 - DNA, 555 bp, Homo sapiens
aatacagatttattaaaacaatattcccttaaaaaatcacggtcaaagtggggtacagggattttcaggcatggtcaggagctccaccaatctaaatcaccacagcctgccgttatataatgctgaatactttcacagatttatagtttatatattataaatttgttacacatatagtttatatatatttattcttaaagtacagttttatatatatatacacatacacacacacacatcacttatagttaataagtatggttatctagtgctgaatacatctgaacataaagggtgagcagtggtgggaaaagactgagaagtcaggagggttggtcagctgcatccactgaagattccatgttgctggtggaagtctccccctcctgccactggtgagaaaaatggctcaaactgttgcttcttcactttaaaaagtttggtggagctcttgtttgccaacagtagcctatggtggcacttgtcttaaattgtgtatcatgcttttcctgctccctccctgcagtggcatagcatgttaataaagatctaact

SEQ ID NO: 369 - DNA, 508 bp, Homo sapiens
  misc_feature (500)..(500): n is a, c, g or t.
ttttttttatggtaaatatgggcccctaatctcttctggattgtagggtttctgctgagaggtctgctgttagcttgatggggttttccatttgtaggcaacctgccctttctttctagccgcctttaacattttgcctttcattttgaccttggaaaatctaatgattatgtgttttggggatgatcttttgtgtagtatcttgtaggggttctctgcatttcctgtatttgaactttggactctctagtgaggttgggtaagtgttaatatatgatatcctgaaatatgttttctaagttgctgctttctctcctcctctttcagggatgacaatgattcatagatttggcctctttgcaaaattcgatatttttcagaggttttgattgatccctttcattcttttttctttatttttgtctgtcttatttcagagagccagtgatcacctgttgagattctttcctctgggtagtctattctgctgtaatacttgngactgcat

SEQ ID NO: 370 - DNA, 182 bp, Homo sapiens
gcggtgcctctgagagccgccgccacctcgtccctcagttcccggcagacagccgcccgggccgcgtccctcaccgccaccagggccggagtgacgagtgagaggggcggccgggacgcgacccccgggccaggagaagcggaggcccgacggcggcggccctccgaggtacggcttcttgg

SEQ ID NO: 371 - DNA, 2825 bp, Homo sapiens
gaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaaaaaaaaaaaaaaaaaaaa

SEQ ID NO: 372 - DNA, 400 bp, Homo sapiens
  misc_feature (310)..(310): n is a, c, g or t.
taatgtatttaggatgtttctttgctctaattcttcagttgtgggcctctcgtcagcctcctgactaacttggttccaatttgttgtcggatttcctgcctctcttcttcagatgtacgctgcaagatgtttttgtcctctagttctttcttagatggtctgttgccaagtttgatagcaagagtatccctccggcgtattttacttgccaaagcactttctccactgccatcctcatcttcgtcttcgtcctcatcatcgggtgtacaagatagggcccgtccgaggtcagaggtcattgggcttgggnattccctgtgggcccttcatcttctgagggcactaaagggattctgaaggattcggcccatcagcccaggggggtcaggtaggctgaggg

SEQ ID NO: 373 - DNA, 6401 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacaatgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttttttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctc

SEQ ID NO: 374 - DNA, 426 bp, Homo sapiens
  misc_feature (415)..(415): n is a, c, g or t.
gcttcactgctttatttttgaaatcacaagcaattcaaagtgatcatcattgaggcttctgttaaaagttcttccaaagttgcccagttttaagattaaacaatattgcactttaagatgaactaacttttgggattctcttcaaagaaggaaagtattgctccatctgtgcttttcttagactaaaagcatactgcagaaaactctattttaaaaatcaacactgcagggtacagtaacataggtaaagtacctgcctattttagaatcctagagaacatttcattggtaagaaactagcccattatttaagtgtccacagtatttttcatttcagtggtccaagatgccgaaggtttccagacaccaatcttggttctctaaatactggctccaggtggggatatccaattcnggtcaccatgg

SEQ ID NO: 375 - DNA, 3925 bp, Homo sapiens
acagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcaggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggattttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaaaaaaaaaaaaaaaaaa

SEQ ID NO: 376 - DNA, 1642 bp, Homo sapiens
tgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 377 - DNA, 435 bp, Homo sapiens
  misc_feature (23)..(23): n is a, c, g or t.
  misc_feature (55)..(55): n is a, c, g or t.
  misc_feature (259)..(259): n is a, c, g or t.
  misc_feature (282)..(282): n is a, c, g or t.
  misc_feature (312)..(312): n is a, c, g or t.
  misc_feature (380)..(380): n is a, c, g or t.
  misc_feature (390)..(390): n is a, c, g or t.
  misc_feature (409)..(409): n is a, c, g or t.
  misc_feature (432)..(432): n is a, c, g or t.
gcagaataaagcctatccttganagccctgaatcatgggcaagaggctcagtggnatctggaggacagggcactggccactgcagtcaccatcttctgccagggagcctgcacctcaggggtgaattctttgccgaaatggattgccaaaacggtcaccagcacatttcccaggggcttgaagttctcaggatccacatgcagcttgtcacagtgcagttcactcagctgggcaaaggtgccttgagatcatccagggngctttatgggcatctcccaaggnagttcaggcaccttcttgccatgtgccttnactttgggggttgcccatgatgggcagaggcagaggacaggtttgccaaagcttttaaaggacctttnggtcctgggntagacaaccgggggccttnccagggttttcctccagcttttncaa

SEQ ID NO: 378 - DNA, 409 bp, Homo sapiens
  misc_feature (264)..(264): n is a, c, g or t.
  misc_feature (284)..(284): n is a, c, g or t.
  misc_feature (383)..(383): n is a, c, g or t.
tttttaggattcctacacttattttataaaagtgaaaattaaatcaaatgatctaactatttccaagcaaattttgggatgaaagctattctaggaaggcttgccttgattcttgctacatgtacttgttcagccactcaattaaattccttctggcctcgtcaatgtagggcttgtctgcaggtgagcaatcttctctcttccgatgcacgaacccatgagtctgcccagaaaatgttttaatttgatattcaactttgcagngttctttcaacttctgaggncaggcaaaggatacgggcccttgagtgggggaatcaccaacatccattttcaggccaaaaatggaccaaagtggggggggttcctttaaattggtaaangtccttcagggaatcccctggacaat

SEQ ID NO: 379 - DNA, 569 bp, Homo sapiens
  misc_feature (484)..(484): n is a, c, g or t.
tttcaagcttttaaatatttatttaatgatacataaagcttaaacagagaaaggtgataaaactgatctgttgctaatactagggcaggaactacagtgagggaagcaagacactgatcgtgaaaaatctgaggcgctcctctgattcatgcaagtacagagttcatcgctgggaattagtgccccattaaattcctcgccctaggagcctgattgccttgccctaaatcctggctctggctactgtccctatcactatgaattagattacttagtatctactacatgctgggcactatacttgatgctttagataacatctcattaattcacaaaaccacctgaaatattcgttgtcctaaccccaattttacacataaaatatcagacaagacaaagtaatttgcacaaggctattttggggtcttgtacaaaccctatacatattatggttctccagttatcattctcaagcaaaactttntaactgctccaaataaaacacattcagtaatttggaatgacagttaatcgaatccaccctctccccaaccaagggaggctgacta

SEQ ID NO: 380 - DNA, 2731 bp, Homo sapiens
ccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccct

SEQ ID NO: 381 - DNA, 4176 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctggg

SEQ ID NO: 382 - DNA, 466 bp, Homo sapiens
gcacccgggccctcgggcaggactcgtcgccgcccggacgcgcccgccccggaccccgagcgcatccagcgcctccgccgtctcatggtggccaaagaggaaggggacggggccgcaggagcgggccggaggggtcctggtcggagcaggaaggcgccacgcaacgtgctcacgcgaatgcccttgcacgaaggcagccctctgggtgaactccatcgctgtatccgtgagggggtgaaggtgaatgttcacatccgcactttcaagggacttcggggcgtctgtacaggcttccttgttgcattcgacaagttctggaatatggcacttactgatgtggatgagacctaccgaaaacctgtcctaggcaaagcatatgaacgggattcttcactgactctcactaggctatttgatcggctgaaacttcaagattcctccaagaaggaagcagattctaagtctg

SEQ ID NO: 383 - DNA, 364 bp, Homo sapiens
  misc_feature (150)..(150): n is a, c, g or t.
  misc_feature (190)..(190): n is a, c, g or t.
  misc_feature (208)..(208): n is a, c, g or t.
ttttttataagcagaaaaaaactttatttctatcaaattgaaaagtatgaaccttcaagcaagataatcaacataatcaataatacaattaacagttaggatagcatatacagatcagactggaggtttagatacttggaagcacatacnccaaaattaagagggccagcaactgtcccaccgaggaaangcactctgactcatcatnaacacacgacttctgggaaacttgagctgacatttcacaggacagtaaaccaaagagacaggttgtcattgggttatagaacctgatctgagcttgagagggatcacagtgaaatgccattgtaactcaacaatttccccagagatctgttcatct

SEQ ID NO: 384 - DNA, 391 bp, Homo sapiens
ctgggcatctaaaagtattgtgttccttagacactgtgcttacagggcctactgggttgattctaaagaagaaagaaaatctatatgcatgaaaagatgtcttaaaaagttttgaactactcaaagttaagatttggggaaatagaaatagtatataacttaagaaaattgccactggctgtgaacccccatggcattttctttgcacttttttgcttctcgttagattgtatgtgtttttaccatttcacacaaacttttaaagattattccacgccgttagctctgtgcttctattagtgtctctatctctctttctctctctcttccatctgagtacaatggctagaaaataatacacacttgaatgaataaatgtcatttaaatatt

SEQ ID NO: 385 - DNA, 486 bp, Homo sapiens
tttcaggattcatggccaaacgtaactatttattcatttttttcttataaacattgagtttcttctttaaaaaaaaaaaaacacctagaatttaaatatttcccatcccatcacatacaagtctgtatacattatttacatcttttgaataaaacatattacagattttctgacatcagtatccctttttaaacaaaaatgaagcaattaaactttgatcagtaacaactacaatttgcataatccggcacagtttgtaatatagcgcctatgttggatttcataacttagatgatttttccccttctagttacttgattataagagagaaactgtctccatgagagtagttccctgtctttatgcactcttctcaatacttgcacagtgtaaatgccgcccttattcttccattacttggcactgacaatattcctctgcttttgtcttcagaaatgatttctatttgaactttaagtgttctca

SEQ ID NO: 386 - DNA, 485 bp, Homo sapiens
  misc_feature (443)..(443): n is a, c, g or t.
tttttttttttttttttaaaaataagaattttttattcttgccttatttcgtagcaaacataaaaccatcctgattttaaaagccaacactgttctttctcctttttccttggatcacaagttcatacagagtcaagcaagtgccccaaagaaaaaccccaaaattgaaaacaagtgtattcccttcagaaaaatcaaagctaggaatgtttagctattgaagtgttttcccccagactgaggatcaagtaacttcactgcagtggctcaagagtggatgactccctccttccaaataaagcacttattgctaattaggcaggccagaggtttaggactgggatctctcataattgggagacttcaaagtgttcaggaacttcaagccgggcctatggaaggtaaaaaaaaaaaaattttttttaagtaggattgccattttntttttctccagggaggtttttcttcaggccttaacactccgt

SEQ ID NO: 387 - DNA, 327 bp, Homo sapiens
tttcatctgatagtttatttaatccttgcaacaattctgtaagatgaacagtgtcattattctctttttctgattgagcaaactaaatttcatagaggctaagggactttctaaagtcacacagctagaatgcggtggtgtcaggattcaactccaagcggtctgactctgcggtcttaaccagtcttaacccacctctctgggtgatagtccagaaatgccaccaagatcacatgtacagccaaggcagacataatgatcagccagggcagggattccctaccaaacacttactccatcttcaccacttttaggatctttcaaata

SEQ ID NO: 388 - DNA, 492 bp, Homo sapiens
tttttttttttcagggagttcagagtttaatagggaagtcagatacctaaatggatattgtacttagacacacagaaataggattcctagagatgtccaagtattagaagaactgagaggaaaggttcttaactcagcctgcggtgcagggccccctggaggaggtgtcatctcctgtattatatgggcttagtaagtcctgaattgaacagctacacatcaagtcttatggtcactttgaagagaataaagccagagggattcctggtgtgtctccgttcttccctgccagggagttagtggttctgagttggccacggtgagtgtgcaactcaccaaacatccctcttcctccttcctttcactcccttctcagagcatgatggaagcctgcgttttcatttcagactgatgggtttctgaaggacaacaacaatgctgcccagcgcctgttggacgggatgaacttcatggctcagtcggtgtccgagc

SEQ ID NO: 389 - DNA, 542 bp, Homo sapiens
gacctgtgtacacgcttatggttgttgagatatgatctctgttcaaaactttgctcacatatatcacatttgtgaggtctctgatcaggaacaggtcttgacagcaacctgaggtttcccccagactccctgctgctctccccgttggtcagtgtgactgccctggggcctctctgctccactagcttttccaggctcccctctgacttactgatgtggtcacaggcttctactggctcagatccctggggatcttcctcaccaaatgtctcctgtgaagtcaactccttgtactcagttctggtcccaagagctgggctgttgactctcaggtgctctttcccagaggtgccctgaacatccaggacccagggctcatcccctcgctccaactgcgagatcactccaggcttggggactgcaggtcctactcccagtgagactaggttcccgtaggtctccagcatcacgtccctgtaagaagccctctgagcaaggcccaggcggtccatttcatccgggaaatgtacacaagcagttct

SEQ ID NO: 390 - DNA, 446 bp, Homo sapiens
  misc_feature (14)..(14): n is a, c, g or t.
  misc_feature (38)..(38): n is a, c, g or t.
tagctttttattcntttatttgaccccgcccacatccntgctgactggtcattttacagagtgctgattggtccattttacagagtgctgattggcccatttttacagagtgctgattggtacgtttacaaactttagctagacacagcactgattggtgcatttacaaatctttagctagacagaaaagttctccaagtccccactcgacccagggaagtccagctggcttcacctctcacccggagcggagattgcagtgagccgagatcgcaccattgcactccagcctgggtcgacagagcgagactccattgtgtagcgggcgtcttctgggcgggtgggacgtagggccgggcgcacggattttccccgtggggtgaaggagtgccctctgcttgggtccatccaggacaccgcttgtcaacaaagtttcccctgcattc

SEQ ID NO: 391 - DNA, 2751 bp, Homo sapiens
agggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgt

SEQ ID NO: 392 - DNA, 480 bp, Homo sapiens
tgagacagagtctcaccctgtcacccaggctggatggagtgcagtggtgtgatctcggctcactgcaagctccgcctcctgggttcacacttctcctgcctcagcctcctgagtagctgggactacaggcgcccgccaccacgcccagctaattttttttgtagttttagtagagtcggggtttcaccgtgttaaccaggatggtctcgatctcctgcccttgtgatccgcccgcctcggcctcccaaagtgctgggattacaggcgtgagctaccacgcccggccgtcttgtgtcttctttactgtgactgggtcgtttttaagaaaggttatcagctttgtgtttggtttcccacagttgataaaaatctatcaaaaacattataatttgcaaggaaaaaggtttttcaatggctgcaggaaccagaaagaaatagcatttcttatctgtataaacacaaacatttaaagctagtcac

SEQ ID NO: 393 - DNA, 463 bp, Homo sapiens
  misc_feature (463)..(463): n is a, c, g or t.
ttttttttttactttcaaaggtgcagacattaatttattaaacactagtcttttctattttaattttcaataacaaacatttttgccttttacaatctcttcacatttgccatttatcacagatctttacgtggtttaaaagcacatcacaaacattcgggagatcatgcatcttcattaactctgaccaggtgtttgctattgcctaccccactcttctcaatgatgtctttgaaagagacagtcctacattgggtattaaaaaggtcaatctttctaaataatcagagcaaaatctctttagccctttaaggttatctgggtttgcaaacagaagaataccacaaatccatttccacttcacagggatctgagtatgcatgcaaatgcacacacacaaagaatgctgtaggactcgagtgtcaaccgcatcttagactccaaatattaccctgactgggcn

SEQ ID NO: 394 - DNA, 181 bp, Homo sapiens
gtggccctcgccgccttccccgccgcccccgggtgggtcagagacccggacccgggccggcaccgggagtcgggacgctcggacgcgcgagagaacagcaggcccgcgggccccggcaggcggctcaagcaggagcgcggccggctagccgggtcaccggtaggccagagccccgcgcgca

SEQ ID NO: 395 - DNA, 275 bp, Homo sapiens
tctaattcttaggatttttattgtatacatattgaaagaccttttgattttaaaaatgtagttttatcatatatcactcataggtatatatacaaagtaaattatgagtgaaataaactagtttcactattctaattattttcccatttataatagtaatcttaattactattcaaaattcttgaataattttgatgatgacaacatatcttagtagaatgttctactactaataacagtatgcttctgagattttttcccctaagcctccagta

SEQ ID NO: 396 - DNA, 389 bp, Homo sapiens
  misc_feature (191)..(191): n is a, c, g or t.
  misc_feature (316)..(316): n is a, c, g or t.
ttttttttctcaaggtatttcttttgtaaaggagccagatttggcaactagactgaaaatcttccaaaattctgtacaaatgtgtaatatacaaatatacacaaggcttttgccaagaaaagacatcacaacaaatgacagaggtggctttggtgtcacataccacctacagcatctcaaacccctaggantgtgaggggctgatggaccacaacataggctacacatgtaaacacgctacattacactatgtacactggagtataaacaatccactgtcctctccggtctgttcacaaggccctctggcggggangggaagggccatttcaccggggcaacccacattaagggggaacttctttaaggtggggaggggagaaccctgc

SEQ ID NO: 397 - DNA, 430 bp, Homo sapiens
  misc_feature (360)..(360): n is a, c, g or t.
aaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtcgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagttgaagctnagattgggccattgcactccagcctgggaaacagagtgaagacgctgtctaaaaaaaaaaaaaaaaaaaa

SEQ ID NO: 398 - DNA, 405 bp, Homo sapiens
ttttttttttttgagacagggtctcgctctgtcacccaggctggagtgcagtggtgagatcttggctcgctgcaacctcctcttgccaggttcaagcgattcttgtgcctcaacctcccaagtagccgggacaacaggcgcgcaccaccagccagctaatttttgtatttttagtagagacggggtctcatcatattgtccaggctggtctcgaattcctgacctcaggtaatccgcctgcctcagcctcccaaagtgctgggattataggcatgagccaccactcctggcctgaaacttggtgcttccttttaataagacatttcatggtttcagaaatgaatttgagtcaacacaaattaccacatttattaatgtttcaatttaatattgctagatatctta

SEQ ID NO: 399 - DNA, 7171 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaaaaaaaa

SEQ ID NO: 400 - DNA, 2214 bp, Homo sapiens
ggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacaaaaaaaaaaaaaaaa

SEQ ID NO: 401 - DNA, 385 bp, Homo sapiens
  misc_feature (28)..(28): n is a, c, g or t.
  misc_feature (61)..(61): n is a, c, g or t.
  misc_feature (344)..(344): n is a, c, g or t.
  misc_feature (374)..(374): n is a, c, g or t.
agataggaaatgaactctattatatatncctttttaatcttttttaaaaaattatactttnctgggatacatgtgcagaatgcataggtttattacacaggtacacacgtgccattgtagtttgctgcacccatcaatccgtcatctacattaggtgtttctcccaatgctatccctcctgtacccctcaccccctaaaaggccctggtttgtgatgtttccctccctgtgtccatgtgttctcattgttcagcttccacttatgagtgagaacatgtgggtgtttggttttctatccttgtgatagtttgctgaggaatgatgggtttccaggcttcatccgngtcccggcaaaggaccatggaactcatccntttttgtgggc

SEQ ID NO: 402 - DNA, 427 bp, Homo sapiens
ccaattctgtggccagcctttcaacttcctctaatttagcctcaagcacttgatcctgttctacctgagtttgttcctgttcttctagtgtcattcgcatgtcttcaattattttctctttaacatttagatctttgcatgctctctcatactgttgtatagcttcttccactttctgattatttaactgctccttgagttgctgaatggttcgctgcttcatatctaattcctgagaacactggtttttgtttttctccagttcattaattttaatcctcagtaatttatcctcatcacgcattacagatacctctttctgtacttgcttaatctgctttttggcatcagtcagtttctctttcaggtcagcataatcttcttccttcctctgaagatctgctttcagattctgggtacgagcaga

SEQ ID NO: 403 - DNA, 1873 bp, Homo sapiens
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgcgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatatcacaaaaaaaaaaaaaaaaaaaaaaaaaaaaaaaaaaaaaaa

SEQ ID NO: 404 - DNA, 339 bp, Homo sapiens
  misc_feature (220)..(220): n is a, c, g or t.
  misc_feature (278)..(278): n is a, c, g or t.
  misc_feature (307)..(307): n is a, c, g or t.
  misc_feature (318)..(318): n is a, c, g or t.
  misc_feature (323)..(323): n is a, c, g or t.
  misc_feature (333)..(333): n is a, c, g or t.
tgtttttatagttaacattttttttaataaataggaaaacaccctaaaataactgtgaaaaatatagtacagtaaatatacaaaccactaacatcgtcatttattattatcaagtattacgtactgtatgtaattgtatgtgctattcttttttacaactggcaaacaagtgagtaatgtgttgctctaccacatgctgatggctataatgtcaccaggnaataggatattttcaggtcctgggatcaccatcatatatttgatctgttggttgactnaaaagttgttatgcagtgccttgattggnatacctttttnaaaantcattggagnccgccc

SEQ ID NO: 405 - DNA, 418 bp, Homo sapiens
tttttttttttttttttttttgcaaaccccattttattcatagtttggggttttttaaattagttcacaaatctggtacataccggcagttaaaactggttatcactttgataatcagaagcctctggtgtaacatagtcttcatgaaaacatattgtaaaacagggagaatacacagtaataatctttttgaaagcaatggctgtaaacatccatgtttctaagaaaatataactttacatatatatgtattttaagcaagctataccttttacataaattcagacagtagaaggagtgtgcaatcataatgcttattttatggaaacagtgaaaataattttaattatgacctaaatgcttctaagtaattaaagtccttttgaattggatgtatagtataaagatattttcccta

SEQ ID NO: 406 - DNA, 389 bp, Homo sapiens
  misc_feature (230)..(230): n is a, c, g or t.
  misc_feature (280)..(280): n is a, c, g or t.
  misc_feature (338)..(338): n is a, c, g or t.
  misc_feature (360)..(360): n is a, c, g or t.
  misc_feature (367)..(367): n is a, c, g or t.
  misc_feature (383)..(383): n is a, c, g or t.
taaaaactatttttaataaacatcatatttacaacatgacgttttgatatacatatacatagtgaaatgattattccagttaaacaaattaatatatccatctcctcatacagttaccgctatttttgtgtatgtggtgagagcacttgaaatctcttctcttagaaaatttccagtattcggctgggcgcggtggctcacgcctgtaatcccaggcactttggggaggnctgaggcgggtgggatcacctgagggtcagggagtttcgaggaccagccngggccaacgtgggtgaaacccgggtctctacaaaaaatacaaaaattgtcccggggcnggggtaggtggggcacacggcntgtaatncccggctactcggggnggctta

SEQ ID NO: 407 - DNA, 112 bp, Homo sapiens
cgtaatttaattgtaaaagatactgacaaactaacttggtttattattttggttatgaccccgtcatttgacttgtctttagttgtcttaacggggactgaatatgcgtgca

SEQ ID NO: 408 - DNA, 5113 bp, Homo sapiens
gctggcggagagcggcctgcgggcgatcgggccgagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcggctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgggtgagcatgctgccatccggcgtggggccagagtacgcagagcgccccgaggtggctcgccgggacagcgcccccaccgagagccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccggccccccagctccctcgccactgccggccacaccactcagcgccaaggaggacgccagcaaagaagacgtcatcttcttctaaaagggccgtgactcaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggttgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatg

SEQ ID NO: 409 - DNA, 464 bp, Homo sapiens
gttggatgttacctttatcagcttcacattctcaagatggtaaaaatcatgtatatagattatcagaactctaagcaaagatgactgtcacatctgaagctgaggtgccttaggtactctactgaccttgatgggtttggagttccccattgcttatcaagagctttttaattgctttggttctttagtttttctttttgcaaaaatccttcctgtcactttaactaaaaaccaaagatttgttttctattgataagcagactagagaaaaactgccttattttcagaagcatgtcttcattcaaagcttaggcttcaatagaaattcagactaatcactgaaatgactatttcaaactagtgaaatatctgggaaataaactgcttcaaaaatattttactgacatgaattttgctagtgaatacaaatacactgcctcaaataaggccatgtatgaatgaac

SEQ ID NO: 410 - DNA, 400 bp, Homo sapiens
  misc_feature (337)..(337): n is a, c, g or t.
  misc_feature (351)..(351): n is a, c, g or t.
  misc_feature (362)..(362): n is a, c, g or t.
  misc_feature (398)..(398): n is a, c, g or t.
ataccaatgaaagaaattggtttaaatttcacagcattaacattactttttaagtaaaacagttcattgaagaaagtatgtatgcagcagtggaacatgggcctgtgctttgcagtgactccaacatcctgtgcctgtcctgggaaggggacgtgtcccaagagtgagaaggagaagcctgtgtgcagggagacgctactatgagggaaggctggctggccacgggcaacgggcgaggagtggttggggtgactttcacctctagtcactgtcgcaggggacaggagtacttccacagagggataaattttcaacctccgggggccacaattggcgnggttttgttaggantccggggcctnccagccgttgattattctggttgggtttcccggaantt

SEQ ID NO: 411 - DNA, 385 bp, Homo sapiens
gatgcttgtggtttattgaagagagcaaggctggtgggcgtggactcaaagcatggcagcggcagaggctggagcagttggggatcttcagcttctaaatgctaattacacagtgagctttgggctattttttccatgagcttaatgatgctttctctgggcttttgggggagggtgtccaccagcttcttcaactgagcccctgcctccctcatgtcttgatcagggctgaaaagttccatggcagcctcataactggagggtgtgtccattaggagggtttcgaggacacgctgaaagctcgggcagatctctgcagaagcggacgggcatcagagagccagtgtgaccaaggtgagggtgacagcgagtgtcatgggtgagg

SEQ ID NO: 412 - DNA, 3995 bp, Homo sapiens
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 413 - DNA, 490 bp, Homo sapiens
gatatggggtttcactatgttgcctaggctaatcttgagctcctgggctcaagcaatcctcctgcttcagcctcccaaagtgctgggactacagatgtgaaccactgtgcccggcatgctgttctttttggagggactcttctttctctctcccacccctgtttcacctggttaacgcttaggcatcttgaagaaaccagaccaggcactaacgaactggaggaggccaaggtccctgtacttcctcaaagctcttattatccttcataattatagagtcttatgattatttacttatctatcactccagctagactataaattctgtgaggccagcagaccttggctgtttgcttattactgtattcccagtgcctagtacagagtaggaccttggtgaatatttattattattattattttgagaaggagtttcgctctgtcacccaggctggagtgctgtggcacaatctcggctcactgcaacctc

SEQ ID NO: 414 - DNA, 566 bp, Homo sapiens
cttttgcaaagggaaagagtgggaaagaagtgtctcttcatagctggcatgggtgatttagatggatttactcacctaagccaacaagtaaatgtacgatttgttactctccaaggtaagttcagaatctccctgttatgcactactctgactctctactgttggttagttcaataataaaattgacttcacagagagctcctctgagtctgaagggtggttggtctccaggagccacctttccaggggccgcgggggtcctggggtatgttacagccacctggaggcccacacaagtacccttcactaggggccattcctgcctcccaggcaggagtcaagtgacagtgtgagtgtgcgtgtgtgtcctgaggtctgggacacttgtccttcaagctgcagcaggaagccagggcataccttctaagattagaacaaatttcctaaggtgccagcccccggtctgcatcccagtcagctgtagcctctcctgttacaagcgtctccaaccctgactcgcttgcagtcagagttagcattttcaggacatggtgctgggcccctgg

SEQ ID NO: 415 - DNA, 328 bp, Homo sapiens
tttttttttttttttttttggatttttaggagagatggggtttctccatgttggtcaggagttccagaccagcctgaccaacctggtgaaagctcatctctactaaatacaaaaaattagccaggcgtggtggtgcatgcctgtaatcccaaccacttgggaggctgaggcaggagaattgcttgaacccaggaggtggagattgcagtgagcctagattgcgccattgcactccggcctggacaacaagagagaaactccatctcaaaaaaaaaattaattaaaaaaaaaaagctgaaggatcagtggggcacggtggctcacgtct

SEQ ID NO: 416 - DNA, 1942 bp, Homo sapiens
agggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtcgggtgcatcatggcagaaatggtcctccataaagtcctgttcccgggaagagactatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctattcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagctttaaaaaaaaaaaaaaaaaa

SEQ ID NO: 417 - DNA, 2437 bp, Homo sapiens
cttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 418 - DNA, 415 bp, Homo sapiens
  misc_feature (277)..(277): n is a, c, g or t.
tttttaggagtccaacttttttaatgtgattctcaagtttttacaatatgttgaataatccatcttttccccattgatttaagatgccatatttatcctatactaagttcctgtacatatttagaactacatctggactttccgttccattgttctacttgttcaatcacatacaaatatgtttgtagagacagggtttcgccaagttgcccaggctagtcttgaactcctgggctcaagcaatccttctgccccggcctcccagggtattgggacncacaggcgtgagccaccacacccacccctattgttgccattgttctagttgctgtgatagaggaaatgtgggaggggggtgttatctgccacctctgtgtccctgtgtcatatccctgggccttccctctgacccagc

SEQ ID NO: 419 - DNA, 1760 bp, Homo sapiens
ggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtccttcctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgg

SEQ ID NO: 420 - DNA, 372 bp, Homo sapiens
ttttttttttttttattttgcaacaattattctttcaataaaggacttgtaaattctctcccacaccacgttagacaggtaagtgacgtcacttccaaatttcaactgttacatagaagatccagaatgtcaacaccacttgcaatctccacaaggttacaaacaacacatacaccttcaattcaaaatacctgaatgaaaggtttcatcccaattatggggaaaaaacttcccatctcacaggctggttaggaaactggttctgaatacagcgtaacatacacaggcaattcaggatcttaaggaaacttcaactgttggccagttaatacagtaggtggaactttatttcggctttcacccttatttcct

SEQ ID NO: 421 - DNA, 3590 bp, Homo sapiens
ggggcgcacagagccagaggggcttgcgagcggcggctgagggaccgcggggagggggcgccgagcggctccagcgcagagactctcactgcacgccggagggcgcccttcctcgctcgcgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctc

SEQ ID NO: 422 - DNA, 301 bp, Homo sapiens
  misc_feature (207)..(207): n is a, c, g or t.
  misc_feature (211)..(211): n is a, c, g or t.
  misc_feature (213)..(214): n is a, c, g or t.
  misc_feature (295)..(295): n is a, c, g or t.
gccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgagngcgntnngttgccccaccaggtcttccggaaccacctggggccgctactgcttggagcacctgccggcagagttccccagcctgggangcttct

SEQ ID NO: 423 - DNA, 388 bp, Homo sapiens
tttttttgttttttgacattttgatgatttatgatgacaacattcacgaaatggatttccacacagtttctccctgatggactcaaaagtgttctctgtggaagacactgagccagaccaagaagcatccaggcccgtcagaaacatggcagacagagcaagagggaggacagtgtagaggtcagagcccaggcgggatacagcacaatgccaccgccatgggcttccgggaaggagtgccaaacgggtgacttggccagaaaggcagcgttggagtgacagagatccttgccacatcccgttctcgacttcttctccaagcctgtgtcgcggtggggctccatttctcaatgggaagagagggcgggaggagttagaaccatcttct

SEQ ID NO: 424 - DNA, 309 bp, Homo sapiens
tttaaaaatcacatatttaatcagaaacttagaaaaggctgaaaatagattcaattatgagatcagcacatttgttcccaagcattacattttcatctgcgttcaacacatgcctcttctacttaagggtcccttccatcaccttcggtttagtctgcaatatgatcatcctatacttaagataaaggcatttatacagtatatgttgtaaataattattttttcactctccccttagcaggtatttgcatctaagttcaagtcaaactgaggaggaggactggggttagaagattcaagcaaggcacg

SEQ ID NO: 425 - DNA, 469 bp, Homo sapiens
ttttttttttttttttttggagacagggtctcactctgccacccaggcgggagtgcactgccatgatcacggctcactgcaatctcaacctcctgggctctggtgatcctcccacctcagcctaccaggtagctgggactacaggcacacaccaccacacacagctaacttttgtaattttagtagagatagggttttggcacgttgcccaggctggtctggaaatcctgggctcaagtgatccgcccaccttggcgtcccaaagtgctgggattacaggtgtgatctaccgcgcccggaccacctgcacatttaaaattgtgaacctctctgtatacttcagtaacttttcaaagatttctttgacacaaagttctcagaaatcttaaagctagcatttcacaacagaaaaaaagagcttctggttcactggtgaaattttactaataaaatttaaaaacaaaaagct

SEQ ID NO: 426 - DNA, 2477 bp, Homo sapiens
agtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 427 - DNA, 4978 bp, Homo sapiens
ggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtaaaaa

SEQ ID NO: 428 - DNA, 396 bp, Homo sapiens
gtttaagttttttgtagattctggatactagccctttgtcagatggatagattgccaacaatcttctcccattctgtaggttgtctattcatgctgttggtagtttctcttactgtgcagaagcgctttagtttagatctgatttgtctattctggcttttgttgccattgcttttggtattttagtcatgaaatctttgcccatgcctatgacctgaatgatgtagcctaggatttcttctagggtttttatggttttaggcctaacatttaagtctttaatccctgttgaattaatttgtgtataaggtgtaaggaaggggatccagtttcagctttctacctatgactagctagttttccagcaccatttattaaatagggaatcctttctca

SEQ ID NO: 429 - DNA, 1198 bp, Homo sapiens
ccggcaaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaa

SEQ ID NO: 430 - DNA, 249 bp, Homo sapiens
tttttttttttttttttttttttttttttttttttttttttttttttttttagagggggaaagatttttttaaaaaaaattcccccttttactttttttttcctttttaaaacccccccccccaaaaaaggggcccccaaaatttttaattcaaaaaccccctttttataaaacctttccgagattgaaggggaaaaaatttttatgctgggcaaaaaattaaaagggggccccccccggggcccgggg

SEQ ID NO: 431 - DNA, 1999 bp, Homo sapiens
gccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttatt

SEQ ID NO: 432 - DNA, 414 bp, Homo sapiens
ctaaaggttgttttattgtaaaaccataaatacaacactgacatgaaatcatttaagcaactgatcctctctaactgttaaaagttatctttttgccttggcatcaaccaactgggaaatagtgctgcaagaattcggggggcaggggaggtactgaatcccgggctggggcttttggcgacttaaagaaccgagtggaaccttcctcttctccctgggaatgttccacttttggacaagaacagacaggtaaaaacagcaacattaaacagctcagttttaaattttattactttgtaaaaatctttttttctgttcctttcctccatttgacatcagtaaatgttttgaacatcatgaaactgatttggctgtaaatggagaaacggcaccaaaacaaagtgaaacaaaaac

SEQ ID NO: 433 - DNA, 3148 bp, Homo sapiens
gtgggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagacttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggca

SEQ ID NO: 434 - DNA, 876 bp, Homo sapiens
agaacctagagcccaaggttcagagtcacccatctcagcaagcccagaagtatctgcaatatctacgatggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaattctgtcatttcaaagactctcacccctgctataactatgaccatgctgataaactgatttatctatttaaatatttatttaactattcataagatttaaattatttttgttcatataacgtcatgtgcacctttacactgtggttagtgtaataaaacatgttccttatatttactc

SEQ ID NO: 435 - DNA, 311 bp, Homo sapiens
ttttttttttttgagacggatctgtactccagcctgggcgacagaccaaggctctgtctcaaaaaaaaaaaaaaaaaaaaaaaaaaaagggaatcccaaccagatactggtgcaaggtcagagatgcagccaatggggagatttgtagaaagctcatagatgataaaaacatgggtctttaggaaaattagaattcagctgagcctcctttcatttggacaatgttcagaagctcttacagggggctatggcaatcttttgatgcttcttatagctttctgaggttaacgcttttgtggtgggcatcggta

SEQ ID NO: 436 - DNA, 368 bp, Homo sapiens
tttaccttaacacatatttatttcacagtttctgtgggtcaggagatcagaaatggttctatttcaaggactctcacagggctgcaatcaagatgttggcatggctggggtctcatctgaaggctggactggagaagaatctacttccaaacttatgtggtagttggaagaatttagttcctcaaggccgctaaactgatggcctgtgttccttgcctatgggatggtagcttgcttcaacaaagtgtgcaagcagagaagacagagagtccgctagcaagatagaagccacaatctcttgtaatctatcatttttgctgtattctactggttaaaaataactcatttaggttagcctactggctctc

SEQ ID NO: 437 - DNA, 392 bp, Homo sapiens
tttttttgtttatagctgctgttaccttttattgagtacccacaatgtgctaggcaactgtgctagatacttttacataatctcatttaatttaaccctcacaacaaccctgtgaggtaggtatttgctccattttacaaatggagaaatcgaggcacaaaagattaaacatcttaccaaagtctgcacagccacttatatgctggagctagaatttgaacccaggtgtgcctccactttttaatactagaccaatcttttcacgggggaagtttcctagattaacaccctcacatcttttaagaccattccaaaacctgcgttctgttttgcagaagccctcactgtgtttctgctgccctgaaacagtggaggcagacaaaggtgagtgc

SEQ ID NO: 438 - DNA, 286 bp, Homo sapiens
ttttttatttttcatcagctctatattttgtcaaactatatatatttttgttacataaagtatatataatagatttagttatttagtaatgattttcaaaattcaattttgaagtatttcttagaagttattgaaatattaaaacatcttgtggttttatagaaatttaagagtaaaactggaatttttaaaatctggcaatttgctctgataggaaaattgccttcattacattattacacagaaaaacaaaaaagccagtgtttcctaatactttctttttttt

SEQ ID NO: 439 - DNA, 5298 bp, Homo sapiens
aagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcatcaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcgtcccataccttgtttttaatctcctgtttgttgagtgcactgactgtgaaacctttaccttttttgttgttgttggcaagctgcaggtttgtaatgcaaaaggctgattactgaaatttaagaaaaaggtt

SEQ ID NO: 440 - DNA, 683 bp, Homo sapiens
  misc_feature (458)..(458): n is a, c, g or t.
  misc_feature (538)..(538): n is a, c, g or t.
  misc_feature (605)..(605): n is a, c, g or t.
  misc_feature (613)..(613): n is a, c, g or t.
  misc_feature (624)..(625): n is a, c, g or t.
  misc_feature (642)..(642): n is a, c, g or t.
  misc_feature (651)..(651): n is a, c, g or t.
taagtgagcatttcttctttatatatgatgtgttcaggtaaataatcaggccttttgaagaatcacacaccagtttccttgatcgtagtagctttgcagaattctgacatcactcacagtcctgcaggcaccttccagttctccctcacggaacacatggtagtaacgatgaaacacaggacttgggtcctgggatcctatgggaccaaatggctcaacaggtttgcctttatcaggatttcccttaaggtgccagggaaccagtacatcttgagaataaaaagaagtcctgttaacatgaacaggcagcttggaattagaaacttgccttgaattacatcctccttcctgagagtcattaatgcgggggacagaagatgccgagtctcgactgcccatgtcacgcatttgctccacaagtgacctctgcactgaggtatcactgttcatctcctctntctttccttggctatttctgtttcctctaagatacttggacttctgcttattatattcttgttccattgcccagacatanatgagtgccttcccacctggtctcaggagtcgaacaatttcttggagagctgccactctacgctctngctgtganaatgatgaatnnacagcatggagatgcangcatcacangacccactgcggactggtactgccaatgcatc

SEQ ID NO: 441 - DNA, 335 bp, Homo sapiens
  misc_feature (1)..(1): n is a, c, g or t.
  misc_feature (15)..(15): n is a, c, g or t.
  misc_feature (306)..(306): n is a, c, g or t.
  misc_feature (328)..(328): n is a, c, g or t.
  misc_feature (334)..(334): n is a, c, g or t.
ntttagtttccaggnttaaatagtagagctgtagtgaagctaccttgtcacatccagaggtcaagtctgcaagcgaggtcaggacttccacatggtcactacgaggctaacttatattcttcctcagtgaccactggctaaactgttacagctttataggcagctaagcatttgaaacatgcactcccaggcaaacaggctctcttgtgcctctctcttccctgaccatatttagtcaaccatagcaaaaaatagcctctcagctgtcgattgtcgatccaaaaggctgagggaagcctcaatctngctttctgcccattggattgtncatccng

SEQ ID NO: 442 - DNA, 329 bp, Homo sapiens
  misc_feature (292)..(292): n is a, c, g or t.
  misc_feature (312)..(312): n is a, c, g or t.
  misc_feature (321)..(321): n is a, c, g or t.
gagacatatgtgactctttgagcttctgtcatccaggtgccatttctgatgcagcacatgtgcactgaacagttggcaaagaaggaaaaagattatggtagatgtatgtgcagatagtctctctaatgatgtaaaatacgtccagaaagaaagcagggctttgttgtaaaataaaaaatttcccatgactttttgttctttctgaatgtgatttgaggcatgtttctgtaaataaggaatatatactaacttatggatgtatataggaaccaaaaataggacttactcatcngggaggtgatggggatttantacccctanattgggcc

SEQ ID NO: 443 - DNA, 3384 bp, Homo sapiens
ccacgcgtccggggacctcgagtgtgaagcatccttccctgtagctgctgtccagtctgcccgccagaccctctggagaagcccctgccccccagcatgggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccacgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggctaaaaaaaaaaaaaaaaaaaaaaaaaaaaaaaaaaaaaaaaaaaaaaaaaaaaa

SEQ ID NO: 444 - DNA, 449 bp, Homo sapiens
  misc_feature (413)..(413): n is a, c, g or t.
  misc_feature (436)..(436): n is a, c, g or t.
  misc_feature (444)..(444): n is a, c, g or t.
tttttttttttttggttgttgttgttgtttgttgttgtagagacagggttttgctatattgcggttttgctatattgcctaggctggtcttgtcttgaacccctaggcgaaaatgatcctcccactttggcctcccaaagtgttgggaaaacaagcatgagccactgtgcccaggctggagagagctttctaatgccacacatcccagcacatcactctgctaatgaagtccagggtagggctcaccattgccctcaggataaatgttagcctgggcaccatgttcttttccatgtgcagtctctgggctgcatcttctttttctaccctactctctaacacatccactgccacactggaattagtttttctgaaatgccattccctttttgggcctcttgggctttttccantggggcgacatttttttgttccngttcaacnttgtt

SEQ ID NO: 445 - DNA, 439 bp, Homo sapiens
tggagagttggatctcgtatcctgcctagactggtcttgaacacctgggctaagcgatcctccacttcagcctccccaagttcttggactacaggcgtcagccaccatgcccagctcctagtgtcctttttagggtcttaagcaccacaaagggaatcttgattaactagtgacaatcacaacaagtccacagccttgctcctagcctgcctccatacagacagcaattaaataccacctgtgtaaactgcaggagagtagttcaaatttggctgagtaactttttcctggcatgaaagaaccggctctaatgactagttcattccagatttcactggacattagatctagtgctttgttttgtttgcaacatttcctatttgcccacacataaatggactttggggtctaaggccccactgctcttcaaatggacatg

SEQ ID NO: 446 - DNA, 422 bp, Homo sapiens
ccctaatggaatgctctgtcctgcttgcaagttttggtgcagagaagccaacaaagatttataaatagggatgctcatgacatcatgatttacgacaggtaaaaacaggaagcattttagatttcaaacaaaaggtagttatcaaatatatcactacacatccaagtaactaaatagcacatttattaaaaactatgagtctaaagaataattaatatcatagggaaaacatttatgtaaaatgttaagcaaaaagttttaagaggttaaaaggaaaaaaaaaatcagggtgcaaaccacatacatagtgtaatctgaatgtccctggctccttgctacttagctggtctacggactagcatcatagcatcaccaggagcttgttggaaatgtaagattttaggctccaccctaaaacccac

SEQ ID NO: 447 - DNA, 581 bp, Homo sapiens
ttttttaatagagacacggtctatgttgcccatgctggtctcaaactcctgggctcaagcaatcctcctgcttcagtctcctaaagtgagccaccatgcctggccggaactcttgttgcaagaacaataagcatccactactgcagctgaaaacatccctgacagacccatctccctggtattcagggagggatggactaggcaatgattcagaagtcatactgaaaagctgcccttttcctactggtgcccctgcagtctgagcccaagcagacacatacttcagaggtgctacatttgtgctacaaagcacagatccttcttgacctggaggccagccttacccactgagaccaggttcctgtagttctccagcatcacttccctgtacagggacttctgtttgaggtccagcagtccccactcttccggggtaaaacccagtgttacatcttcaaaggtcactggttcctaaaaatccagattcttgttcagccacaggccatccgcatccacgacaaaagaaagacaggggaggctgaccaggccagtgaaagcacagaatggtctacaagatgacc

SEQ ID NO: 448 - DNA, 1662 bp, Homo sapiens
gcggccgcgaccgccggggacgagcttggaggaaaaggaaccgggagccgcccacccgggggcgctctccggacccccagggtcctagcgcgcggcccttaccgagcctgggcgcccggatttcggsagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagctcaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatctccatgccgaatacaatcgacagaaggacatctacctagcacatcgtgtggcccaagcttgggaattggcccagttcatccaccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacagtggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggccctttaaaaaaaaaaaaaaaaaa

SEQ ID NO: 449 - DNA, 465 bp, Homo sapiens
tttttgagatggagtctcgctctgtcacccaggctggagtgcagtggcgctatcccagctcactgcaagcttggcctccagggttcacgccattctcctgcctcagcctcccgagtagctgggactacaggcatccgccaccacgcccggctaattttttgtatttttctttagtagagacggagtttcactgtgctagccaggatggtctcaatctcctgacctcgtgatctgcctgcctcggcctcccagagtgctgggattacaggtgtgagccaccgtgcccagccagcatagtatctttaatggttttttttgagacagggtctttcactgtcacccaggctggagtgcagtggcgtgatcttggctcactatagcctcaacttcccaggctcaagcaatcctcccacctcagcctcccgagtagctgggactataggtgtgcaccaccacacctggcta

SEQ ID NO: 450 - DNA, 379 bp, Homo sapiens
tttttttttttttcttttactttcctttcatttttggaattgtggcaccactctctggcagtggacaggaagatcagagaaagagaatgagttccaggacaccagcgttcagccaagtcaggcggatgggtgaagcaggagggtgtcagagacttgggtgctcctgtcttggaacggggtatctagggagcaggtgggaaggaattgtagctcctggcttctttatctgaggcgaagagaagctctgctttagccgtctttgcagggcactgctggattaatggttcactttccactcactagactctgattccttgaggataggaacaatatctatttctctttgcttggctttctgctatataagtcctcagtaaat

SEQ ID NO: 451 - DNA, 458 bp, Homo sapiens
  misc_feature (51)..(51): n is a, c, g or t.
  misc_feature (306)..(306): n is a, c, g or t.
  misc_feature (396)..(396): n is a, c, g or t.
  misc_feature (407)..(407): n is a, c, g or t.
  misc_feature (421)..(421): n is a, c, g or t.
  misc_feature (451)..(451): n is a, c, g or t.
ttttttttgagaaggagtcttgctctgtcgcccaggctggagtgcagtggncgttctcagctcactgcaagctacagctcctgggttcatgccattttcctgcctcagcctcccgagtagccgggaccacaggcgcctgcaccacgcctggccaattttttgtattttcagcagagacggggtttcaccgtgccagccaggatggtcttgatctcctgatctcgtgatctgcccacctcagccccccaaagtggatgcattaaatttaagatgcctgttagatgtccaagtggagagtcagttttntggggaagaggcgaatctggaagtcaaaggagatggtcaagttgaagacataaactttgagtttataaattgactaataaaacagacctncgaggaccatnagccaaaatttttntaaagctttcatatacggatggctataatnattactt

SEQ ID NO: 452 - DNA, 3542 bp, Homo sapiens
cccacgcgtccgctccctctctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcggctggctgactggatccacagcagtgggggctgggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtggtgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgag

SEQ ID NO: 453 - DNA, 452 bp, Homo sapiens
  misc_feature (4)..(4): n is a, c, g or t.
  misc_feature (10)..(11): n is a, c, g or t.
  misc_feature (13)..(13): n is a, c, g or t.
  misc_feature (15)..(15): n is a, c, g or t.
  misc_feature (38)..(38): n is a, c, g or t.
gcgnccgcgnngngngcaaggtgctgagcgcccctagngcctcccttgccgcctccctcctctgcccggccgtagcagtgcacatggggtgttggaggtagatgggctcccggccgggaggcggcggtggatgcggcgctgggcagaagcagccgccgattccagctgccccgcgcgccccggccaccttgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattgggcacataccgccatgttgaccgtgccaccggccaggtgcttaacttgtggacaagtgtccagcaggaacctatgtctctgagcattgt

SEQ ID NO: 454 - DNA, 1842 bp, Homo sapiens
gagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctag

SEQ ID NO: 455 - DNA, 1703 bp, Homo sapiens
ggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatgaaaaaaaaaaaaaaaaaaaaaaaaaaaaa

SEQ ID NO: 456 - DNA, 471 bp, Homo sapiens
  misc_feature (4)..(4): n is a, c, g or t.
  misc_feature (15)..(15): n is a, c, g or t.
  misc_feature (125)..(125): n is a, c, g or t.
  misc_feature (259)..(259): n is a, c, g or t.
  misc_feature (261)..(261): n is a, c, g or t.
  misc_feature (430)..(430): n is a, c, g or t.
gcgnccgctgccttnggacccagcgccacccgcacacggcgctccgctagccaggccgggagcaagagccaggcggtcggagaagccgccgtcggagaagccgcggctgaggcgctcgtcgcgcngggcccaggaggagggccgggggagccgccgccgcctgagctggcgttgctcccgccaccgccgccgccgccgccgactcccgcgaccccgacgtcctcggcgtccaacctggacctgggcgagcagcgggacntngggagacgttccagaagcggcagaagcttacctccgagggtgccgcaagctcctgctagacacctttgaataccaagggcctggtgaaagcacacaggaggctgccacttgtggaagcagttcgtttttgaaagttttgggcctcagcagactttgcatatatttgaantggaattgcagcattttgcaagaagaagcagaatagacact

SEQ ID NO: 457 - DNA, 3579 bp, Homo sapiens
cacgcgtccgcgagaaggaggactcgcaagcctcggcggcccggaaccggcctcggactgtcgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagacaaagtgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattaaaaaaaaaaaaaaaa

SEQ ID NO: 458 - DNA, 495 bp, Homo sapiens
ttttttggtccattctgccaatctgtatcttaagtggagcatttaggccgtttacattcaatgttcatgtcgagatgtgagatactttctccgtcatcatgttgattgttacctactttattttctcattgtattactgttttataggcctgtgagttttacgctttcaagagattctattctggtgcacatcaaccttttgtttcaagttttagaactcctagcattcttgcagggcttgtctagtagtaacaaattgcctcagcatttgcttgtctgaaaatgactttatttctccttcatttatggaacttagttttgcaggatacaaaattcttgcctgacaattattctctttaaagagactaaagaggtcaggtgcggtggctcatgcctataatcccagcactttaggaggcaaaggagggcagatcacaaggtcaggaaatcaagaccatcctggctaacacagtgaaaccccatctctactaaaac

SEQ ID NO: 459 - DNA, 2521 bp, Homo sapiens
gaagctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacataggaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggcttcctgtccccatttttaacctcagccttccctactgtcaccaacaaccaagctaaataaagtcaacagcctgatgtgt

SEQ ID NO: 460 - DNA, 5120 bp, Homo sapiens
cctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaatggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgcagggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtcc

SEQ ID NO: 461 - DNA, 289 bp, Homo sapiens
agcaaaaacagcttttttattgtggtagtttgtggtatgtgctcctggatcatgcagaaaaaaggctgggccctcagttagctccgggagccattcttaggaccctccggctgcacacagagaggggctgggtagctggctgggctggggcacgcattcactgggctggcacaggctgaggggtctctcgcccactatcattaggcccctccagcccgttatgttcagcccccggctcaggatgctccagggcgtgccgggtatcagcctgccagagctgcaccaggtc

SEQ ID NO: 462 - DNA, 4201 bp, Homo sapiens
ggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctggattgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagactagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacag

SEQ ID NO: 463 - DNA, 444 bp, Homo sapiens
  misc_feature (353)..(353): n is a, c, g or t.
tttttttttttttagagttttacccagcctttatttctattaacaagcatctcagttaaaagagcaaagtttttgttttgtgccttcaaaaaccggtcttttagtacgtggggatacacatctaacccactggggaagaaggtcaatgaactattctaaaagagtgggttttgtgctgtaactcccactgactggtcttggattcaaggggtccttccactttacaatgaactgcgccattatctgtcctttgagcaataactgaaggaagctccatttctgatggaaccattcatgggaaacctttggattccctctctccatcttttctcggctgaagattgtgtcctggncactgtcaaactcagactcggataccatcagggctgggagttgtgctctgtgcttcggtgcttgataccatatttggggcctcagttccat

SEQ ID NO: 464 - DNA, 302 bp, Homo sapiens
ttttactagatattcagaaaaaagattttattcttctgctgaaatgtttgaaagtgaaattattttgtagagcattttccctttaaactgcaaagaagccccaaggtcattggtacttggaagtccagggagaaagagcgctgggttaatgatggagaaaagataggtgggcagactggggcgtagtcccttggtgtggacgccccagcgtgctcttatttcagtgctcaccctgttacgtgtgtctggggccactgactttctcctgcaagctgtggatctgaatttaactcaaatgggga

SEQ ID NO: 465 - DNA, 474 bp, Homo sapiens
ggccgagcggggccgcgggcggatggaggtctggggggggtcggccgggaacgccggcgccgggagcctccgaggccgacggctcttctggggccgcccctgcccccgcggagtgattcagccccggctcgctgcctctgcccggcgggtcggtgcatccccgaaccgaggcccggggcgttccgctccagcagaccgaagccagaaacgccgcccccgccacccaggccgagtgtgtcgagaaggggccggcgcccttttcagggtgtcaggggactgtgtgcccggtaggagggggcgcctcccggagcccgaagggagggcgcggtaggcagccgagggtggcggggggccacccctccacctccaggggcgggcggctccttcaggcaggtgacagcagcgggacaggagtgctttgccctccaggacctgcgcaccctcctgtctacctggaggccctcttcgccatcg

SEQ ID NO: 466 - DNA, 3434 bp, Homo sapiens
cgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggctttgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggacggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatgggggatttggcacaaaatggagcattaaaggtaacccctgccccc

SEQ ID NO: 467 - DNA, 491 bp, Homo sapiens
acggttcatatctttattttgttacttgattcccagtcttacaatagctcttctcagattattctcaactttacaagataatttggagttactgcttttcaaaatcctttggtaattgcttgtgcctaaatcatgccaccttattccatgggatccattaatatttgggtaactagacaagggtatttagcaatccagggatgcagatgctgtgaaatgggttttcacagatacggagctgcagcttaacgttatcttcagagagacagaaagcggagtctcattatcattttctaaattttttgccaaagggaagttcagttccatatctcttgcttttctttttgcttatcttgtttttctacacacctcactggctgctccttctcagcctcctttgataattcctctgcacctcccagatctttaaacacgggtatgtttcaggactcagttctctcacacaggtgatctctttgtattctgcagct

SEQ ID NO: 468 - DNA, 4739 bp, Homo sapiens
ggcagggccggaaggagtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcagcaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctcaaaaaaaaaaaaaaaaaa

SEQ ID NO: 469 - DNA, 354 bp, Homo sapiens
aaagggtgtggccggccgaggagtgcgggggagtgtgcgccgcgggcactgcagcagccgcaccacctcctcccgtagccctccctccgtccagcagccgcctctgtcgcgctgcagtctggcggctggaggcttgaaggtggctgcccgagggtcgtccaggggccggggctgggtcctagcgggtacccggggataaaagcgagaaaagagagaaccgtatggctttaagtaggtaaaaagtctcgaggaggatgggaaagacttagggaaacctttgagaggtaacgggaccagggatttccagggagcagcaaagccgcgagtggcaccaaaagcaagagggacgtttca

SEQ ID NO: 470 - DNA, 387 bp, Homo sapiens
ttttcttctccatagctttaataaaatgaccttttaaaagaccctttcatatgaggttgatacctccgagaactttatctttccgtagaggtctttgaaacttctgttccacattcgttcctttgttttgtccaaaccttgggaatagatggctgcgtttggaatttatttgatgtgcatatgcagtctgtcatctttccagccaatcccatattgctgtcttgcctcttcattatctccccaacttttgtctttaatgtgggtgctcaaatgtggcagaacagctgtagagtgacgtgatcagccaaatggtccactgcggatagaagcgaaagactgtaagacaggtcaggaacacagaactattggtcgtcccttccaagtgcg

SEQ ID NO: 471 - DNA, 392 bp, Homo sapiens
ttttttttttttttttttttttttttccaaacaacttttgtcattaacatttatttcaattaaaaaaatgtgaatccagaattaatgtaaggggaaatattaaagtatctggcgaaaaaaatgctattaaaagtttaagtaaaatgtttgcggtcccagggctatgtttaacaaacaaacattaacaaaattaaaaacacattctttttttgttttaaattgaaatggagtcttgctctgtcacccaggctaggagcgcagtggcatgatctaagttcactgaaacctttgccacccgggttcaaacaatttttgtgcctaagcctcccgagtagctgggactacaggtgtatgccaccatgcctggctaatctttttgtatttttagtaaa

SEQ ID NO: 472 - DNA, 342 bp, Homo sapiens
cttttttttttgagacggagtctcgttctgttgcccaggctggagtggcgcaatctctgctcactgcagcctccgcctcctgggttcaagggattctcctgcctcggcctcccaagtaactgggattagagtctgggccgatcacagtggctcatgcctgtaatcccagcactttgggaggccgaggcgggtggatcacctgaggtcaggagaccagcctggccgacatggtgaaacttcgtctctactaaaaatacaaaaattggctgggtgtggtggtgggcgcgtgtagtcccagctgcttgggaggctgaggcaggagaatcacttgaacctgggagg

SEQ ID NO: 473 - DNA, 3653 bp, Homo sapiens
gcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtccccgagctccgcacagtgcgccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttgaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtcaaa

SEQ ID NO: 474 - DNA, 3912 bp, Homo sapiens
gccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcatagaaaaaaaaaaaaaa

SEQ ID NO: 475 - DNA, 291 bp, Homo sapiens
tttaaaatttctcagattcttttatttctaaatggattagtgtgaatttcaagccacatagtgtttctttgcttaagttcctccgttgctgtaaaacacccaaaatcaggcggtaacaaggggccgcaaaggctagaacacttaactgcctggagacatccatttgaaggatgtgagggttaaaagggaacagaatcaggcctatttttaatagcctgtctgtttcatccattattttggtgtggaggagggtataaatctcagctgtactccgttgccactaggtaggac

SEQ ID NO: 476 - DNA, 2298 bp, Homo sapiens
cttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctctgtggtcaaaaaaaaaaaaaaaaaaaaaa

SEQ ID NO: 477 - DNA, 330 bp, Homo sapiens
  misc_feature (319)..(319): n is a, c, g or t.
ttttttttttagaatgaaaatgatttccgtatttatgtttgtcagcaatatagttatttacaaataacccatatgaaaatgtaaaaaagcatattacatcttcacatgccatctgtattgactgaataaagcttagtgacattatttgcaaatctgtagttaattgtacatagacattttgtgcgttaaaaaggaaatgtacataatgtaaaataaattacattacgcaatttacaaagtaatattaacaaaaattcttaggacagctgcctccttatttaaacaaaataaatattcaggtagttaaattaacataaantacacatttag

SEQ ID NO: 478 - DNA, 421 bp, Homo sapiens
  misc_feature (371)..(371): n is a, c, g or t.
ttgagatggagtttagctcttgttgcccaggctggagtgcaatggtgtgatcttggctcaccacaacctccacttcccgggttcaagcgattctcctgcctcagcctccagagtagctgggattaccatgtgccaccatgcccagctaatttctgtatatttagtagagactgggtttctctatgttggtcaggctagtctcgaacttccaacctcaggtgatccgcccacctcagcctcccaaagtgctgggattacaggcatgaaccaccgtgcccagcctctaaagctaattttcaatcttattttgttaaaagttgttactgtatactttgtgtatttatttttttggggggtgggggtggagcagnctcactctgttgcccaggctagagtgctgtggtacgatcttggcttaccg

SEQ ID NO: 479 - DNA, 457 bp, Homo sapiens
  misc_feature (281)..(281): n is a, c, g or t.
  misc_feature (389)..(389): n is a, c, g or t.
  misc_feature (446)..(446): n is a, c, g or t.
ttttttttttttttcatttggacaagcttaaaacacgatgtggactcgtttttattttatctcagaaaaaaacattccctttagaaggaaaggcagttagacaaggcctctcactgggtagctctgcgctactcagcacatgccagtggcctgccagccccaacctctcccctgggacctgggcccatgctctggcactgctctgttacaactccctgtccttgatcccagctttgtcactccaagagatggccctgggactgagaagtggatggcagctntgacagcaggagaggactgcctgaggctccccgggcagaggctctggtgccaggttagcagcaggaccgacggcagacccagcagccagagagtgaaaggtaataaantaaaaagggtttcctcacatttacatttttcctgggaaaaaaagtcaaattttcacnttgggcccagc

SEQ ID NO: 480 - DNA, 400 bp, Homo sapiens
  misc_feature (360)..(360): n is a, c, g or t.
  misc_feature (386)..(386): n is a, c, g or t.
atagagtttcactgttgtcacccaggctggtctcagctcactgcaacctccacttcctgggtacaagcgattctcctgcctcagcttcctgtgtagctgggattacaggtgtgcaaccacaaggctcggctaatttttttgtatttttagtagagatggggtttcaccatgttggccaggctggtctcgaactcctgacctcaagtgatccacccacctcggcctcgcaaagtgctgagattacaggtgtgagccactgtgcccagccgagacttcattgtttaatgtatatttttattttttccaaacaccagctcgaatcagagtatatttttattttgccacatacctttaaaaggnatttattgtgtcataatgttttaaangttaaatatatggt

SEQ ID NO: 481 - DNA, 360 bp, Homo sapiens
tttttttttttttttcaaacctctggtggcctctgtttcctttgctggtttttatgctgccatgatctacgtttatggaaagcaagctgccataaaggtatagtcgagaagattctgccctcagctctcttttcctcttaatgttctcttccttgaagatctgattcttcttgtggataacttccaaacctacacctttctgcctcatttttttccaaagcctgggacccacattttcaactgtttggagcacttttatcacaggcgccttaaaattatcattcccaaagcaagctcatcttcccttatcgtacttgtatgcttctttcttcctggcttctttgacttccctcccatttt

SEQ ID NO: 482 - DNA, 387 bp, Homo sapiens
gctttcttgattttatttcaaaagtacacaaggtcacaaaactagagcaagttgtttttcttaacaaattttgttcttacaaatttcaaaatctgcaccattggatatataagccagaaatcgtacatacaaaatctgaaactgacactgtcagttctatactttgcacacgtgaagtgtcagaatattttcttcagtagtacaggtgtatttatcactaaaattcacaattagggaaaagaataagtgaatcaatgaattgtggttctcttaaaacttgtgtcattaaataagttagcagaaaacacaaagttctgttttgatggagcttttagtctcgatgaccaaaaccaaacccaactgatatgtactatattcttaaattat

SEQ ID NO: 483 - DNA, 396 bp, Homo sapiens
ttgccccggctggagtgcaatggcagagtaaccgctcactgcaacctctgcttcccaggttcaagcaactctcctgcctcagcctcctgagtagctgggattacaggtgcctgccacccagcccggctaattttttttatttttagtagagacggggtttcgccatgctggccaggctggtctccaactcctgacctcaggtgatctgcccacctcagcctccaaaagtgctgggattacaggcatggggctgcagtaagccgagactgcaccattgcactgcagcctgggtgacaagagccaaactccatctcaaaaaaaaaaattttttttttaccacttattccagttcaggggttgggggtggctggaagcctatctcagcagcttaggggg

SEQ ID NO: 484 - DNA, 5379 bp, Homo sapiens
gcacttccttctcggctagattatctgaaactgttgtcggttcttgagatgatactaccaccgaatgtctgtgtttcattgtctagtccaacctgtattgtggatatctacaacgttccggcaatagttttgcaggtgcatcacatttttgtttttgttttgggaggaaaagggagggcacggcagccaggcttcatattcctacaagtgcatgcttcaagattactgtacttacagtgtttccaacatcttctcataaaaggggaaagcttcatagcctcaaccatgaaggaaaccagtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccgctggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcaatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaataaaaaataaaaaca

SEQ ID NO: 485 - DNA, 4490 bp, Homo sapiens
caggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctgtaagtcgccccggctggtccctccatggcactctgggtcctctcctcactctccagagaccctcacatgtccttttgaacatccaaagagcaggtccctgaaagcaccttcctggaggatgtgggagggccctggacatggcccggccccactgctgagtgcccgtgtccccacagccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgttaaaaaaaaaaaaaaaaaaaaaaaaaaaaaaaaaaa

SEQ ID NO: 486 - DNA, 5059 bp, Homo sapiens
ctggttctcaacttcttttgaaataatgttcatagagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcag

SEQ ID NO: 487 - DNA, 1813 bp, Homo sapiens
gaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggagctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgaaaaaaaaaaaaaaaaaaaaaaaaaaa

SEQ ID NO: 488 - DNA, 530 bp, Homo sapiens
  misc_feature (3)..(3): n is a, c, g or t.
  misc_feature (69)..(69): n is a, c, g or t.
  misc_feature (173)..(173): n is a, c, g or t.
  misc_feature (393)..(393): n is a, c, g or t.
  misc_feature (509)..(509): n is a, c, g or t.
ctngaactgcagcgggtggcagtagagaagagcatcacagaagttgctcaggagctgacagagctggtnggaacatcttgtagacattgtcagaagcctgcagaatcagaggcccctatcagaatctggaccagacaacgaactgagcatcctgggcaaggctttttcttctnggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctgggaagcccccgtcttcctcctcatggcccatttgccttggaccaagagccacccttgnactcaagggagagcttctcgggttttgctcagttgggccatccatccaacctttaactttgaagagcctttcctgcagccttggaggtgtccaaggattcccggtacagtgactgngttttcaccggcccaaaaccc

SEQ ID NO: 489 - DNA, 320 bp, Homo sapiens
ttttttttttttttttttgagacagagtctcgctcttcttgcccaggggggagtgcaatggcgctatctctgctcactgcaacctccacttgccaggttcaagcgattctcctgcctcagcctcctgagtagctgggattaaggcgtgtgccaccacgtccggctaattttgatttttagtaaagatggggtttcaccctgttggtggtcaggctggtctcgaactcctgacctcaagtgatccacctgcctcagcctcccaaagtgctgggattacaggcgtgagtcaccacgcctggccttcacccttttcaatactg

SEQ ID NO: 490 - DNA, 536 bp, Homo sapiens
tcaagagaaattatttatttatattacttatatcatacatattaatgtatagcattatctatatttattttttacttattattgggagtaaggggaagaacttgaactagtaacatttctaccagaacttcacagtaccggtgttttcgctttattttaaactagccatcatgaaaaatctgatttaatactttcaagcactttcagttatgactattcaatcatgatatgaatcagcaaattggttgctccattaaactgcttttaagactaccaaaaacttgcccagctcttctgtcatacctttagcagaggaaatggaagaagctattacaaggacgcctgaaaacttgaaaagtttcaaaacctggacaattactcaacagcattttcctctgaaagacattttgtagacgtttcccatgattatctcctattccggatggcccatcaaatcacattctaaacaggcattcaacacttattaagcagccactgtgtgcagagacagcactatactaagcaaaggagcatag

SEQ ID NO: 491 - DNA, 421 bp, Homo sapiens
gcacaattaaaaatatttaatatttttatgttgaaagttcaaaatgaactttacaagagcagaaaaatgaagtattagaaattataaattcagaatttgccatttatgtcttctacaaaaagtggagaaatataattactggttaatgttcgtgatgacagcttaagaaataagcctactattttcagtgcatcctatttatactatatagtgtttgccatttgttcagagggtggctcttttcaatatattctagaagcaagataaactcttggacactggggtgaattgtctggtgaaatgtatccagtaggcagtggtttgtgccagtgtttggaagaagactggcttctgctcctgctttccatggacgctgatctgtccctcttagcctttcaggtctgtcctctctgccttcatt

SEQ ID NO: 492 - DNA, 410 bp, Homo sapiens
  misc_feature (281)..(281): n is a, c, g or t.
  misc_feature (307)..(307): n is a, c, g or t.
  misc_feature (329)..(329): n is a, c, g or t.
  misc_feature (334)..(334): n is a, c, g or t.
  misc_feature (340)..(340): n is a, c, g or t.
  misc_feature (361)..(361): n is a, c, g or t.
  misc_feature (389)..(389): n is a, c, g or t.
tttttttttatgaacagatatttagacatttcacattttgtaaaaccacgtctacaatctccaattccattcttctgagaggcaaaattttacaattaatatagaaggcagagttttttaaacaccttaagtttacttattaattagtatagtagcatatttcagattcttagaatatggagctagagggtgctctttcatactagaaaaccaactatgttggtttttgtactattgtacagtgtgttcaaatatagatactgaagacctctgcaaaattntaatcaaaatctcctttcagtttgtnaaataatttcttgggaggaccnctganagaganaagtgtcctcatgggtgaaancgtgaatctccttcccaaattaatttcntcataaaagggcagtttctga

SEQ ID NO: 493 - DNA, 396 bp, Homo sapiens
  misc_feature (2)..(2): n is a, c, g or t.
  misc_feature (135)..(135): n is a, c, g or t.
  misc_feature (202)..(202): n is a, c, g or t.
  misc_feature (217)..(217): n is a, c, g or t.
  misc_feature (242)..(242): n is a, c, g or t.
  misc_feature (263)..(263): n is a, c, g or t.
  misc_feature (276)..(276): n is a, c, g or t.
tnccctttttattaaaaatagactcaagcactttatgtatcatacaaaagtttcattcgctggtggcagccacgggaaagactggccccgtagcactgattttccacctcccctccagggacttgggtcccaggngcagtgactgggcctcagagaaagcccataaagactgcttactctggaagcagccgactaggggctnttccgcgagcagctntccccaccccacccaatggcaaaanttagatactcgaaagtgcctnttcagtgccaagntaaactaacaagtggagtgaaatggaaaaccctttgattattttactatttcccagggcctgggattttgagttttccctgcactcaagtccttttccctacaaataggggtaggaaact

SEQ ID NO: 494 - DNA, 406 bp, Homo sapiens
ttttttctgagacggagtcttgctctgtcccccaggccggagtgcagtggcgccatctcatctcactgcaagctccgcctcccgggttcacgcccttctcctgcctcagcctcccgagttgctgggactacaggcgcccgccaccacgcccggctaatttttgtatttttagtagagaaggggtttcaccgtgttagccataatggtctcgatctcctgacctcatgatccacccgtctcagcctcccaaagtgctaggattacaggcgtgagccagcgcgcccggcctaccctccctattttcaaaaacattgtggcaatggacaaaattcacatgtacaaccgatcattacaatcagacgctctgtgatacgtgtaccaacgacaagggctgaaataatgactg

SEQ ID NO: 495 - DNA, 411 bp, Homo sapiens
agtttttgagacggagtctccctctgttgcccagtctggagtgcagtggcatgatcttggctcactgcaacctccatctcctgggctcaagcgattctcctgactcagcctcccaagtagctgggattacaggtgcctgccaccatgtccggctaattttgtatttttagtacagacagggtttcttcatgttggtcaggctggactcgaactcctggtctcaactgcctcagcctcccaaagtgctgggattataggcatgagataccgtgcctggcctccatcactgattctatgtatgcacatgactccttttttacttttacttaggaggcttaaaacacaattattcattcaatataattataaagcagagtctttgttaacttctgaacttggtaaaaacatttt

SEQ ID NO: 496 - DNA, 296 bp, Homo sapiens
ttttttttttttttttcctgcctcatgctttattttccatagagcttgtttccatccatacctcctctggtctcatccatgctgattccagggtccaggttctcaggtctgaggtccataatgtcaggtgaagccctgcccataccattgcctagtggccaacacccccgcccaccacagcctgatgaaccctttgtcaaccagggttttttattccaacaaagaatctcgtatccctgagggcacacagtgaggctgcctcactcctcttccatgctaaggatttgcagcaggat

SEQ ID NO: 497 - DNA, 420 bp, Homo sapiens
  misc_feature (151)..(151): n is a, c, g or t.
  misc_feature (404)..(404): n is a, c, g or t.
gatcttctcaaaatgtatcatttcagtttatatctttggttatgcattaaatatgagtgaaattcatgggttcccatgtacattatgaatcagattctaaactcaggaggaaagagaaacaattaaaacttcattagaagcagaataaatngtgcaaaaactcttaaaataccaaaaatgttaaaggaaaaaaagtgcttgccatagtagaaaaacaaattggccacattgaattgttccttccttcatggtgatgagatgtgtggggcctgtgcctctcccctcagtgaccacatgcgggtttccctgcacactaaagaaccacgtgtcccagggagcaaatgtgtcctcggttcccgcctcagcccttcccagactcaggaaggcctgccagcctcctgagntcctatacacttcctc

SEQ ID NO: 498 - DNA, 7850 bp, Homo sapiens
gtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggt

SEQ ID NO: 499 - DNA, 2954 bp, Homo sapiens
tccctcctctgctgggcctgggggtctgggccagcaacaagttagtattgcagacatgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaaggccagggaggtccccggggacctggcattctggggagaccctgcttctatcttggctgccatcatccctcccagcctatttctgctcctctcttctctcttggacctattttaagaagcttgctaacctaaatattctagaactttcccagcctcgtagcccagcacttctcaaacttggaaatgcatgcgaatcacccggggttcgtgttaaatgcagattctgactcagcaggtctgagtgggtccaggattctgtgtttctcatatgttcctgggtgatgctgatggggtcagtctatgaaccacactggagcaaccaggttctaggactttctcaatattctagtactttctgaacattctggaatcctccccacattctagaattctcccaacatttttttttcttgagacagagtcttgctctgttgcccaggctagagtgcagtggtgcaatctcagttcactgcaacctctgcctcccgggttcaagcgattcttctgcctcagcctccctagtggctgggattacaggcgcctgctaccatgcctggctaatttttgtatttttagtagagatggggtttcaccatattggccaggctggtcttgaactcctgacttcaggtgacccacccgcctcggcctctcaaaatgctgggattacaggtgtgagccaccgtgcctggccaattccaacattcttaaattctctcatccctccagggctccccgtgctatgttctctttaccccttccccctcttctcttgctcaggcctgcaccactgcagccaccgttcatttattcattcattaaacactgagcactcactctgtgctgggtcccgggaagggtgagggggtcagacacaggccctgcccctgccctcagtgactggccagtccagcccaggcggggagagatgtgtacataggttttaaagcagacccagagctcatgggggcctgtgttctgggtgttcaggtgctgctggtcctccattacccactgctccccaaggctggtgggacggggtcccggtggcaggggcaggtatctccttcccgttcctcatccacctgcccagtgctcatcgttacagcaaaccccagggggccttggccaggtcaagggttctgtgaggagaggacccaggagtgtgggggcatttggggggtgaagtggcccccgaagaatggaacccacacccatagctctccccacagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgaggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggcaaaaaaaaaaaaaaaaaa

SEQ ID NO: 500 - DNA, 245 bp, Homo sapiens
ttctttaagagatggggcctctctatgttgctcaggctggtcatgaattccagccctcaaatgatcctcccaccttggcttctccaagtgctgggattacaggtgtgactcaccatgctcggccagatcatcacttttctgtcacttaaatctcttgataaaggtgcttgatctcaaattttctcttctttaccttagctcctataccactaaagtcttctttgaaaaaaaaaaaaatcactttt

SEQ ID NO: 501 - DNA, 543 bp, Homo sapiens
tttttagggtataaaaagacagatgcaaccatacatttaatttttaaaaatggaatgtatcttacataaggattttgtgaaaaatcttatacctatctgagtattacagaagatgcatataccttccagagctcatggaggaaagagtgtataaacaattttgataaggagttgaaaaacaatttgaaaatagtttacaaagagagaatcaggaggcagaaaaagcttcaagaggcatggtcttcagaaattgttctggaatgctgtttcacttgtatcgatgtcatgttcctggttcaatttcttgaactccaccacttggaagaagacgtgctcaaggatatgtttggcatcctgttggtcctttggtagtttactggttactccaagaatatcaccacacttcctgacataaaattccaggtcttcttcagtacacttattggtaatctgagccagccgtgccttctcagaggagaacgtttcatctaaatcaaatagctccagaggaggaggtggtaactccggaaactgggaggaaaa

SEQ ID NO: 502 - DNA, 467 bp, Homo sapiens
taaagacagagtctcattctgtcacccaggctggagcccagtggcaggatctcagctcagtgcaatctccacctcccgggttcaagcgattctcatgtctcagcctcctgagcagctgggaccacaggtgcccaccatcacgcccggccaatttttgtattcttagtagactgggttccgtcacgctggccaggctggtctcgaactcctgacctcaggtgatccgcccaccttggcctcccaaaatgctgggattacaggtgtgagccactgcgcccggcctattgtgatatttctttacttaataactagcagatgaatctcttaacagtattctgttttcctctaagcatgcataaaaagtggtcaaataagtccatgatgactcatcaccttttccctgcaaggagtgtactgtagattaccaaacctgcagaagccgtctgtgtggagacaggaggaggaca

SEQ ID NO: 503 - DNA, 368 bp, Homo sapiens
  misc_feature (317)..(317): n is a, c, g or t.
ttttttttttttttttaaatctccacttccattttcaaacaaaatttcctttgagatttttttccccctctttgggaatagggtctcgccctgttgcccaggctggagtgcagtggcgtgatctcggctcgctgcacctctgcctcctggctttcaagctgaggtgggaggattgcttgagcctaggaggtcgaggctgcagtgggctgtggtctcgccgctgcactccagcctgggactacagagtgagaccctgtctcaaaaaaatttatcatgggcatgacaaatgctgtgattcggtgtactgattgggtccnaaacatttgctacaaatataggaaaatgtatatactccctaaggattaaat

SEQ ID NO: 504 - DNA, 486 bp, Homo sapiens
tttattcttagaagacatttttattataagtggattaacttacttggttttgtctctatctcaaatacgtaggtgagaaaacacaggtaattatactttgacaattacagtagccacaaaaagttagtgttttcttcaatttatggtactgaagagtatctttgtaattaaaatgtgaagcaatccattttcatgtcagttacccttgattgccaggttggcctataaatctatattgcttggagtgctggcttttcattacttaatagtttgcattcagtggaggaggatatccaccctctaagtaacagagaatggaactcatctttcacttctgaatgagctcctcactgtaattgatggcatttcctgaaatggctgcgatcattagggctccagtgacatgaaataggatgtttctcttctttcagctagttgtacgaaagtttccagtggatggatgtgtcacagagaaaggggcactgg

SEQ ID NO: 505 - DNA, 427 bp, Homo sapiens
tttgcggtcaccgtcttttgcaagtttattcaaccagtgttcattgagtgggtgccttgtgccacatcctgtgcttcacagattacagtagcccacttatccttgaggagtgggcatagtaccccagtctagagatgggagcactgaggttcaatgaagatctgaaataggtctcaggctgactccagagcttgtcctctttactgtatatcctcttgacgttatagtccaagggatctccctttatagtccaaaggaatctttcttggcatgtaacaagcacaatcttaaacttcttaagcttcagatgtacctggggtgttgattaacaggcagattcctgggccctacttcaagtgaatctgattctagaagtctggagttggagccccagaaactgcatgttcaatcctaacccccaatttag

SEQ ID NO: 506 - DNA, 219 bp, Homo sapiens
  misc_feature (211)..(211): n is a, c, g or t.
tctcatgcctttttgcctagtgtatatgctgtctccctttagttgtcaaacctgtatctttgtgttgaaagttttgtagatagcatattgttagcttgaaaaaaaaatccaggctgggtgcagtggctcacgcctgtaatcccaacactttgggaagctgaagtgggcggatcgcctgaagtctggcgttcgagaccagcctgaacatggngaaaccct

SEQ ID NO: 507 - DNA, 421 bp, Homo sapiens
ttttttttttttattttacaaatacacttttattttttggaatacattttacaaataaatattaaatgaaatttacacacataacagtaaatctcaaatacaggcataaaattattctaatataatttacaaacctgtgcaaaaatcttaaccagtcgtgagttgtgtgagggtcgaatttgcaaatattctctccaccactgcttagcatatacaagaaataatcgctctttctctgcagttttctgacgttccaaagcaagctgtgtgttcactacttcttgagataacgtttgattgagtggtggatacatttcaagttttatatttaaaattcccacagaaacttttgattctgtgcccataagttccacagtcagactggtcactccattttctgagcccaaaaccgatcgccatt

SEQ ID NO: 508 - DNA, 385 bp, Homo sapiens
tctgtttttacaagattttattgattatgtcttgaatttataggaaaccaacatgaggtcttggaacagaacccgtaattacaacattgttcctaagggaaaataggatccactttatagtgtggcttttaggaacacagcgtggcaaaaatcagggtggccaatgccatgtttgcttcattaataaaacttcaagcatttattttgccgttcttgtgtgctgggtgcatactctgaggttgctctctcgatctgttccgtcgccctccgctccatctccctcagctgtattactgccatgcctttgtttatgaacacccatgcttcctccaaaccaacaagttattatccatttgtgaaaggcttcatttcaggattaatcaga

SEQ ID NO: 509 - DNA, 421 bp, Homo sapiens
  misc_feature (145)..(145): n is a, c, g or t.
  misc_feature (394)..(394): n is a, c, g or t.
  misc_feature (407)..(407): n is a, c, g or t.
gttttcttatttgctttgttttatttttcttgtgaaatacattgtaaatgaaaagcatataagtaatgcatattaacaatttaaataattattttacaaagaaaacctgtgtactcggcagccaacttaagaaacagaaactttngatggcagaggtgggcggattacttaagaccaggagttccactcgcctggacctcccaaagtgctgggactacaagcatgagccaccacacccggcctctaccaaaaattttaaaaggccgggcttggtggcatgtgcctgcagtcccagctgttactcaggaggctgagacaggaggatcgcttgagtctgggaggcttgaggcttgcagtgagccatgatcgccaccattgctctccagcctcagcnaacggaacgagancccatctctaaaaa

SEQ ID NO: 510 - DNA, 1931 bp, Homo sapiens
gcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacgggttgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgaaaaaaaaaaaaaaaaaaaaaa

SEQ ID NO: 511 - DNA, 512 bp, Homo sapiens
  misc_feature (375)..(375): n is a, c, g or t.
  misc_feature (455)..(455): n is a, c, g or t.
  misc_feature (460)..(460): n is a, c, g or t.
  misc_feature (492)..(492): n is a, c, g or t.
ttattttttaaattttcttttattttactttaagttccaggatacatgtgcagaggtgcaggtttgttacagaggtatacatgtgccatggtggtttgctgcacctatgaacctgtcatctaggttttaagccccacacgcattaggtatttgtcctaatgctgtccccctgctggccccccgtgccccaacaggtcccatgtgtgatgttcccctccctgtgtccatgtgttctcattgttcaactcccatttatgagtgcaaacatgtgggagtttgggttttctgttcctgtgttaggttgctgagggatgatggatttccaggcttcatccatggttcctgcaaagggacatggaactcatccttttttanggctgcgtaggtattccaggggtgtatatggtgccacaattttctttatccaggtacatcattgatgggggcattggggntgggntccaaggtctttggctattgtggaccgggtgnccacataaacatacaagggg

SEQ ID NO: 512 - DNA, 475 bp, Homo sapiens
ttttttttttagtctagttaggggtttgtctattttatttatttatttattttttcgaaaagccagctcctggattcattgattttttagagtttttcatgtctctatctccttcagatccactctgatcttggttatttcttgtctcctgctagctttgggtttgttcactcttgtatctctagatctttttgttgtgatgttaagctgtcgatttgagatctttctagctttttgatgtgggcatttagtgctataaaattttctattaacactgttttagctgcatcccagagattctggtaccttgtctcttttttctcattagtttcaaagaacttgttgatttctgctttaacctcattatttacccaggagtcattcgggagcaggttgttcaatttccatataggtgtgtgaggttcctaatcttgagttctaatttggttgtgctgtggtctgagagactatttct

SEQ ID NO: 513 - DNA, 317 bp, Homo sapiens
ttggtttttccactggctttatttccactgaaagaagaattgacagacaggaggctgaattatgaaatgatggaacaactgaacagaaaataatttaacaagtccacaaattatgttttctgctggaatgtatactagccattatttcctatctgatcactgtacaaaattgttttctatgtttagcactataatcttgtctagcatcgcctttaccagacttcactctgctttattctacttctacagtgtaccaaggtgattttaaattctaaccctgtccaaccaaagttctatttacctttctatggacatct

SEQ ID NO: 514 - DNA, 411 bp, Homo sapiens
tccccaagtactagcttccagccagattgtcatttgtgcgttaaacagtacacacccatgctggtgtgcctttgcgcaaatgaaaataatctgattaggaagctacagagagttaaaccatcaatcctgcactggggcccactgcaaagacctgggcactggaaacagtgctctgtcacactgagtcagcagctgggacacgtatgatgtgtgcctcttgtccagagctttataaagagaacagaagcaggggacagggtaaggctgaatgtctgcagcctgtacataagacacgtttggggaaacaggaaaactctcagcgtggttaacttattgtttacctaaactgtttatgatatgactcccagggcaagcattaataaagcaacaaaaaatgttagcagaacactt

SEQ ID NO: 515 - DNA, 296 bp, Homo sapiens
gccctttatatgcttcatgttccagtctatttattttatttttatttttgggggggtgggggctagctatgttgcgcaggctggtttcaaactcctgggttcatgtgattctcccagctcagcctcccaagcaggtggaactaaggcatgaatcaccatgcctgactcatgttcccttccatatttctgaatagaataaacaaatatcgttaagatgtctaatcatgtcaattaatttacaagtttcttgcaattacaaacataatggtaattgcagtatacgctttcactgttta

SEQ ID NO: 516 - DNA, 194 bp, Homo sapiens
actaaaaataacaggttttattcagaatgacacggtccttgctcaagaacaacaggagtaaccagagaatgaggggagataagttagcaatcagtattgataaagaaacatttgagaaacaccccaaaactgaagtactgatcagcagcctggcccaggttccttagaagtgagacctgtatatgttcccgtta

SEQ ID NO: 517 - DNA, 360 bp, Homo sapiens
gacaggaaaacttcacataaattactttattataaagtgcaagtacaaaaatgcatacaaaaagtggcatgagagaagtataaattgttaaggggtgatgcgggcaaaggagctcaaacatgaagagaagtaatactacaataaaattattaaccagactccgacgtcagtaaagtgcattaacccaaaatgcaaataatagatgaggtagaaaatgcgattaagaaagcgaatttttctcttggcaattcatgggtgagacatcaatgtgatatcagattcaaacataaaataaagatctctatgtggggggatttgtccaatatccaattaaaggatttatagtgaaaactgtaactg

SEQ ID NO: 518 - DNA, 390 bp, Homo sapiens
tttaagatggagtcttactctgtcgcccagactggagtggtgcgatctcggctcactgcaacctccaactcctggggtcaagcaattctcctgcctcagctttccaagtagctgggactacaggtgtgcgccgccacacccagctaatttttgtattttttagtagagacagggcttcactatatgttggcaagactggtctcgaacccctgacctcaggtaatctgcctgccttggcttccctaagtgctgggattacagttgtgagccaccacgcccagccagcactaccttttctattgtgcatcctaatggtctgtagtatagacatatttataggggaaagaaaggaatagatgtgggcaaaaagaagctaaaaaacattccacg

SEQ ID NO: 519 - DNA, 270 bp, Homo sapiens
tttttttttttttttgctcacagaatgtatacgtttattttttaacggagttaattcatggccgggtgttgtggctcccacctgtaatcccagcactttgggaggctgaggcgggtggatcacctgaggtcaggagttcaagatcagcctggccaaaatggtgaaacctcatctctactaaaaatacaaaaattagccaggtgtgatggcatgtacctataatcccagctactcaggaggctgagacaggagaatcgcttgaatctggga

SEQ ID NO: 520 - DNA, 397 bp, Homo sapiens
  misc_feature (371)..(371): n is a, c, g or t.
gggtgctgtaaaataaatgcaactttacagaatatggtaaaagtggaggatagacaaagcacattaaatattcagctactatttacaatttctcccacaattacatgttaaaacatactttttttttcaagttgctgtttaaatctaggcaaaagtgcttaaaaaaatctttcactatttacagttaaaaccagaccacataaatgctcaggacatcttacaacgaccctccgccagtgcttccaaacagatacagtaaacacccagcaggccggttctcagctcttactcaagggcacccgggaagctcagggaacttgcctataggcgggtcatctggattggtttaaaccatggatttcatggaaggnccccattatctggaattaacctggct

SEQ ID NO: 521 - DNA, 420 bp, Homo sapiens
ttttttaacattttatcattttttattgatctacaacatatcatttaagtaataaccatgtgcttttctgtatagcaacttcaaaaaaaaatcccctagtgccccttatcggccagatcactgcctcacatgttcctaatgcattcccatatagaaactctgctaaagagtgtagaatgtgaaagagattaaagaaacgccccacagtggaatccccacccaatctgttttctgcaggagctatcgtggttcctctacagctgtgtatctagaaccaggctcacctggagggcttgggaaactcagatcctggggcccacctccagagttcctgattcactgggtatggggtggggcctgagaatgtgcatttttcacaagcttctcccaggggaagctgacactgttggtcctggaaac

SEQ ID NO: 522 - DNA, 337 bp, Homo sapiens
tttttttttttttttttttttttttttaagaaggagtctcactcttggcacccaggttggagggcaggggcacaatctcagctcactgcaacctctgcctcccagattgaagcgattcttctgcctcagcctcctgagtagctggtattataggcgcccgccaccatggggtttcaccatgttggccaggctggtctcaggtgatccacctgcatcggcctcccaaagggctgggattacaggagtgagccactgcacccggctggcattctattcttttcatggatcctttcttggccccttttaataaaaaatatgtatctctgcttcactcctg

SEQ ID NO: 523 - DNA, 495 bp, Homo sapiens
tttggacattattattattccttttgtttaatgatcattattgaaaagaattctgttgtatggaggaaggaagcattaaaaaccaattcttgaccaggggcagtggctcatgccagtaatccccgcactttggaaggccgaggcaggcggtcctgaagtcggtagtttcagaccagcctgatcaacatagagaaaccccatctttactaaaagtagaaaatcagccaggtgtggtggtgggttcctgtaatcccacctactcgggtggctgaggcaggagaatcacttgaacccgggaggtagaggttgtggtgagccgagatcgagccactgcactccggcttgggcaacaagagcgaaactcagtgtcaaaaagagaaacaaaaaacaaaaacaaaccaactgtctgtaagtgaatcacatggtaggtccgccagtggagacagcagattgagcagtctagtctgctccttccatggcccctcgctggtgatg

SEQ ID NO: 524 - DNA, 436 bp, Homo sapiens
  misc_feature (316)..(316): n is a, c, g or t.
tatttttgagacagagtctcactctgttgctcaggctggagtgcaggggtgcgatctcggcctgggaaaccgagcaaaactccatctcaaaattaaagcagtgtgtagagggaaatttatagcactaaatgcccacaagagaaagcaggaaagatctaaaatcaacaccctaacatcacaattaaaagacctagagaagcaagagcaaacaaattcaaaagctagcagaagacaagaaataactaagattagagcaggactgaaggagatagagaccacgaaaaaaacaatgaatccagagcctggttttttgaanaagatcaacaaaatagattagactgctaggccagactaataaagaagaaaagaggagaaagaatccaattaaatggcaataaaaaatgaatacaggggggatatttaccacccggatccc

SEQ ID NO: 525 - DNA, 431 bp, Homo sapiens
ttcgacagtcttgctctgtcgcccaggccagagtacagtggcgtgatcttggctcactgcaacctctgcctcccgggttcaagcgattctcctgcctcagcctccctagtagctgggattacaggcgcccaccaccatgcttgggtaatttttgtatttttagtagagacggggtttcaccatgttggctgggctggtctcaaacttctggcatcaagtgatccgcctgcctcagcctcccaaagtgctgggatgacaggcgtgaggcactgcgcctggtccattacatattcttattcggatcttattcggatctagggcttctattagccgtacttccaaaggagggcaattgttcgtccttctagtagccattgctgaagggtctgtgagaaatgatttggaaaaaaaataggtgagcagatacaaat

SEQ ID NO: 526 - DNA, 267 bp, Homo sapiens
tttttttttttttttttagttagtgaaaatatatatttgccaacctaaaaatatagaacataagaatttgctagttttatttgtaacttaaaaattaaaatttaaacatggtaatggggggtggccttgtgacctgcttctccaggcatagcctaaaaaaggctgtgtgcggtcctaaaagaatcagacttttggcttatctatccagagtgtccaggtagcattaaggtgggaagggaggtagctataggaagaggagacagtgtt

SEQ ID NO: 527 - DNA, 3952 bp, Homo sapiens
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcgatagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatacccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccggaattc

SEQ ID NO: 528 - DNA, 911 bp, Homo sapiens
tgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacggggtacgacaaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgcgacccggtcgccaggacctcgccgctgcagaccccggctgcccccggcgccgccgcggggcctgcgctcagcccggtgccacctgtggtccacctggccctccgccaagccggcgacgacttctcccgccgctaccgcggcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcatctggtgatgtgagtctgggctgaggccacaggtccgagatcgggggttggagtgcgggtgggctcctgggcaatgggaggctgtggagccggcgaaataaaatcagagttgttgcttcccggcgtgtccctacctcctcctctggacaaagcgttcactcccaacctgac

SEQ ID NO: 529 - DNA, 556 bp, Homo sapiens
  misc_feature (324)..(324): n is a, c, g or t.
  misc_feature (528)..(528): n is a, c, g or t.
cggatcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctnaaagagtgtcgagttatagcagtgctggattgggagctgtcaaccattgggtccatcctttgtccagacttaagctcatttttccctgttctacttttggccaaggacagttccaatgataaatcaaggttcttatagtgaaaactcagggataccatcaatggaagaactgatttcaataatattgccgctgcagggggaatnatccaatcctcccaactggaatttcctt

SEQ ID NO: 530 - DNA, 438 bp, Homo sapiens
tggagacgcagtctcactctgtcaccaggctggagtgaagtggtaccatctctgcttactgcatcctccgtctcccgggttcaagcaattctcctgcctcagcctcccaagtggctgggactacaggcgcaaaccaccacgcccgggtaatttttttacgtttagtagaggcggggtttcaccatgctatccaggatggtttcgatctcttgacctggtgatctgcccacctcggccttccaaagtgctggtattacaggcatgaaccaccagcccagccaattttaaatacttggcctcatcgattatctccttaaatacaaactaacttacaaacgacactatttgaattcgaaaatattgtcaccaaaaccaatggcactaatatctcaggtcacctatgcataactaaattgtttctttgtagtctcagctact

SEQ ID NO: 531 - DNA, 576 bp, Homo sapiens
aaccttttttttttttttttttggtctaagtaagatattagggctcgtgtttacaaaagtaaatgaaaggatcaaataacatgattaatacattttattacaaaggttttagaagatgaggggcagagctaacaaattaccttaatcattaaaaaaccacaaagttggagaatttttttaaaaagagtggataccaaaatagcttttaggaagacgacagcttaatagtctcttaaattgctgaagagagcaaaagaaagcttaagatctggaggataaaagttatatcaaaaacatgctaaagaatacattaaaacaaacaaaaaggaaagaggaaaaaataaactatgccttagaagttaaatccctatcctaaatgaacatcatttctaaaggactatggcccacttcaacactcaaacaaaaaaatcctcattgctaaaacagcttcaacattcctttggagtttgctgttaaagaatttatcctgcatatatggtagacacgaaacacatcctgaagagactcagaatatctgcaaacataaaactgcttctctaaattgcatttactggc

SEQ ID NO: 532 - DNA, 446 bp, Homo sapiens
  misc_feature (1)..(2): n is a, c, g or t.
  misc_feature (5)..(5): n is a, c, g or t.
  misc_feature (272)..(272): n is a, c, g or t.
  misc_feature (356)..(356): n is a, c, g or t.
  misc_feature (426)..(426): n is a, c, g or t.
  misc_feature (440)..(440): n is a, c, g or t.
nntanttggagtcccactcttgttgccctggctggagtgcaatggtgtgatcttggctcactgcaacctccgcctcccgggttcaagcatttcttctgcctcagcctcccaagtagctgagattacaggtgcctgccaccacgcccagctaattttgtattttcagtagagacagggtttcaccatgttggtcagctggtcttgaactcctgacctcaggcgatctacccgccttggcctctcaaagtgttgggattacagggcgtgacacncgcggcctgaacttgttaactgtgttcacagggaggcattattgacagtaggacaaaaggtgggaaggcaacctatgtgtctgnggggtaaatgaaatggggttctatggcatacagtgggagtattatttcaggccttaaaaggggagggaanttttgatcataggnggacag

SEQ ID NO: 533 - DNA, 406 bp, Homo sapiens
  misc_feature (5)..(5): n is a, c, g or t.
  misc_feature (235)..(235): n is a, c, g or t.
  misc_feature (298)..(298): n is a, c, g or t.
  misc_feature (345)..(345): n is a, c, g or t.
ttttntatttatttttagagacaaggtcttgctatgttgcctaggctggtcttgaactccttgggctcaagtaatcctcccacttcagcctcccaaagtgttgggattacaggcatgagccgccagctcccagtctctttactctttaaacatgtaaaactatcttcagctcgtggcttctacccacagaaccatccactcatgcactccccagggcactgtcctgcagaatccntgactgagtagtgctatgaattttcaaggaaacccttccggcatttggagaagcaccagggtnccttgaaaagcacacggctttaaaataccactggcccaccttgccancattcaagcttgcagatctgcagttcagagttttggggaccttggcaatttgtcactgcct

SEQ ID NO: 534 - DNA, 487 bp, Homo sapiens
tcctctcatttatttatttatttatttatttatttagagacagggtcttgatctgttgcccaggctggaaggcagtggtgctatctcagctcactgcaacctttgcctcctaggctcaggtgatcctcccacctgagcctccctccccagtagctgggactataggcatgcgccaccacacctggttaatttttgtattttttttttttttgtaaagacagggattcaccatgttggacaggctggtctcaaaatcctggggtcaagcaatccacccgtctcagcctcccaagtacctggtactataagggtgccatgatggacagcttaaactctgtgttcctaactacaaattatgcttatttaattatattcagtgacttaattaaccagggttttctttaatcctctgatgtttttttctctttctcttttttttttctttttttgagacagggtctccctctgtcacccacactggagtgca

SEQ ID NO: 535 - DNA, 398 bp, Homo sapiens
agaaggggatgagggaaagcgcacgcaaagagtaggcaggccagccacacgagggcccagcgcttgtggatgtatttgtccatggggcaggcccatagcgctcccaagtcatcgtcccatagctgcagacactggcctgactgcaggtcttgtagtaagtactctccaaggcgagctgccctcgtggaggctttgctgggtagtgaagtacagccactgggttccaaggcacagagggatctgttgtcctgggggcctcgtgtctccaacagtagcacatcgtctttgagaggccccagggagtcagcccacaagcactcctgcagctgcagcttcttccgagctgttcacctgaacacagagggttagggtggcctttcagcaatgggaactcgaga

SEQ ID NO: 536 - DNA, 485 bp, Homo sapiens
tttcaatttttaaaatctttaatagtgtctctgaaaaaaaaaaattatccatggaaatgctcagaggagaatcacagaacctcagtgtgagcaaggaagttgacagtggccaggaggcacccaggcagtccccacaggtggccatagcacctccatctccaaagatcactcataggcactatctcatcctgctcgctctcccaaaacagccaccctgggcagcatcccgcctccccggcaaacaggattccttcaccccatggctgaggaggaggagccttttgagagacccaagagagtccactgtcagaggtggggacagtcagggagctggctgagaacattccttttgggagtgcgagcctcctggctgacatattggaaaacaggtggggattctcttgatggacagtgactgccacctttctggtcagtccacacgcctgccttgtgtatgaagtcttacgaagcatagctattcactg

SEQ ID NO: 537 - DNA, 416 bp, Homo sapiens
  misc_feature (2)..(3): n is a, c, g or t.
  misc_feature (350)..(350): n is a, c, g or t.
  misc_feature (389)..(389): n is a, c, g or t.
  misc_feature (413)..(413): n is a, c, g or t.
tnnaagttttggtggagatgttgccccggctggtctcaagctcctgagctcaagcgatccacccacctcagcatcacagagtgcagggattacaggcatgagcaccaagttctgatcaacggtactaaccgcagtttcaggcatccactcggggtcttggcacacattccccacggataggggaggatggctgtatcactccttaagagcaacaggcagccagggaccccagctcaacacccaccgacacatgatgtctactgtgttctgaacatgcataagcatataatttgaactgcattgttagccttcagggaaaggggcaccagggagctgtgcttggccagggnacctagatccatttacttgtttcaaaaccaacccagggngctgagcttacttgaggcttcagnctc

SEQ ID NO: 538 - DNA, 429 bp, Homo sapiens
cctgcactctggcgcccagcagcactggtccggccactctgcggagatctccacgctggccctcagccacagtgcccaggtcctggcctctgcctcgggccgaagcagcacgaccgcccattgtcagatccgcgtctgggacgtgtctggcggcctctgccagcatctcattttcccccatagcaccacccgggctggccctggccttctcaccagatgacaggcttcttgtcacactgggggaccacgatggccgcaccctcgccctgtggggcacggccacctatgacctcgtgtcctccacccgcctcccggagccggtgcatggtgtggccttcaacccctgggacgccggtgagctcacctgtgtgggccagggcactgtcaccttctggctccttcagcagcgtggggcagacatcagccttc

SEQ ID NO: 539 - DNA, 289 bp, Homo sapiens
  misc_feature (9)..(9): n is a, c, g or t.
  misc_feature (42)..(42): n is a, c, g or t.
  misc_feature (47)..(47): n is a, c, g or t.
  misc_feature (201)..(201): n is a, c, g or t.
gtcaagtgnagctcgggggccaaggtgctggccacgctgtgnggcanggagagcacagacacggagcgggcccctggaaggacactttctactcgctgggctccagctggacattaccttccgctccgactactccaacgagaagccgttcacgggttcgaggccttctatgcagccgaggacattgacgagtgccaggtngccccgggagaggcgcccacctgcgaccaccactgccacaaccacctggggcggttttttattgtttcttgccgcgagcttacgttct

SEQ ID NO: 540 - DNA, 179 bp, Homo sapiens
  misc_feature (165)..(165): n is a, c, g or t.
tttttttttaatttcagacagaatctcactcggtcgcccaggctggagtgcaatggtgcgatctcggctcactgcaacctctgcctcctggattcaggcaattctcctggctcagcctcctgagtagctgggattacaggcacccaccaccatgcccagctattntctgtatttttagt

SEQ ID NO: 541 - DNA, 1276 bp, Homo sapiens
ctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgcctcccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggctccccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaa

SEQ ID NO: 542 - DNA, 413 bp, Homo sapiens
tttggagtatgccagggagggttttaatgatggaccttggactccaggttgggtaaggaggaagtaaagacaagaagggtggcagggaaaaggggggggtctggggatctggatcaaggggacttgaaaaggtgggaagatcaggctggtggggctgagaatccatcttccagtgggagttacctgaagtggtccacctggttgagcacgtagatgtggtgccggatcttcttcctgctcaggaagcggcgcatgtggggcacgaagaccaggagctcctcgaagcgttcgcggaagggcaccagcactgccaggcggtgggggccccaggatgcgtcttcttcccagtgctcaaggggcggctctggggggcaggcgcggggagggcccgaggtctcctgcccttgtcccct

SEQ ID NO: 543 - DNA, 461 bp, Homo sapiens
ttttttttttttctttttttccgggtccctccagccccaacagcctgtcctggtgcagtccttccctctgacctggcttgaaatttctcccaggccaaggcagtgagccatgatcccaattccatgtcaggggcaagagtgaattctgggttccgaggcctaactatctcgtctttccactagcccaggaaagtgaactgcaaaacttctttaaaagggtccaactaagcaagcccttcctatcttcagaggcagcctgtgaatgtgaatgtacgaaaggagatttgcttctgcggcatcccaggaggccataggggccatatcggttctcctctagataggccagtggttcccttatagacgctgaaggagaagctaatgtggggagaagaaaaggtgagcttctaacagctgagggtgggagttttcttaggggagagaaaaaattgtttgaaaaaaac

SEQ ID NO: 544 - DNA, 241 bp, Homo sapiens
tttcaaatatacattatttaatagctacaggaggagtcataaatatttatgaaagcggaaactgagcttcatgcctcttcatggaagcctggaggcatgggtggagttttctgccctctgatgtcaaaaggtgaagcagaggacactaaggtactcagtgtgcatcctttgtagactggccagagccactccaaggtcagtggtctattatcaggaaggaatgctggttagttgttgtgtc

SEQ ID NO: 545 - DNA, 560 bp, Homo sapiens
  misc_feature (506)..(506): n is a, c, g or t.
ctactactactaaattcgcggccgcgtcgacccccatccaatgcctgccccctcccccatcactcttttgcactttttactgtggtgaagtgtaaccaatgtctttagagctgaggtctaacagacttctgtgaaaactttctgaaaaaaaccacaaaacaaaaataaacaaaagtgaagagccaagaatgcaaaattaaaaccccctggataaaattactaatcacaacagcatgttattatagggttaattttaaataatgatgcaaatcccaaacctgatctagtagagagagaactggttttgacagaccttaaaagagctatcttagaactcatttcaggtttgtaatatccaattaagattttagtttgttggactatttctagtgactctctggcttcttgtgtggaaactccagttgaattttacagatttctgcttttgtgccccaaatgctttttaaaaatctgatttttaaagtttattgaatatcaataaactntatttcagagtttattttgatttgctgtatttcacagtatattcccaaaatgag

SEQ ID NO: 546 - DNA, 467 bp, Homo sapiens
  misc_feature (215)..(215): n is a, c, g or t.
  misc_feature (217)..(217): n is a, c, g or t.
  misc_feature (385)..(385): n is a, c, g or t.
  misc_feature (396)..(396): n is a, c, g or t.
  misc_feature (411)..(411): n is a, c, g or t.
  misc_feature (431)..(431): n is a, c, g or t.
  misc_feature (437)..(437): n is a, c, g or t.
  misc_feature (454)..(454): n is a, c, g or t.
gacacctttatttatgccacagatctgctccatgtcaccagggcactcttatgtcacaatcccgcccaagcacgccttcccatcctgccctgccggagcacccctctcctccccttagtgaggaaggatttgggcctcagatcctggtggtcccaggactccagcgcctgctgtggtggggtagggtggggtagggtgggatgggggcgcggcananttcccaaggaagtcaccggacctcgcctcaggatattcagaagtgctagttcagttctggcagccttcctcctttaaggtgaaatccgagaacactcttccttccaggggagagcaactgacctgcaatcccagctacttaggaggccaaagcaggagaatcgctttnaacctggggangcagaggtttcagtnagcccagatcacaacatttncacttnagccttggggaacaagngagaaacttcatt

SEQ ID NO: 547 - DNA, 483 bp, Homo sapiens
tttttttttttttttagtaaaaagaagaaagtatcagatgacactacatgatattttactatgaaaatactagatgtcacttgcctataaaatgggactatcaggtgtatgctgttattttctgtatttgtcagaggtttgttttgttgttgttttttaagagacagagtctctgtcaccatcctggagtatggtggcatcatcatagctcactgcagccttgaactcctgcactcaagtgaccctctctcctcaccctcacaagtaactagaactacaggcacatatcatcaagccaggcaaatttattttttgtagatatgggggtcttactatgttgctaaggctggtctcgaactcctggcctcaagcaatccttccaccatggcgtcccaaagcactggcattacaggcatgagccaaggcccctggcctatacttttcagagtttttgagaaattgaaaaaataaaataatgtaggt

SEQ ID NO: 548 - DNA, 316 bp, Homo sapiens
aagaaaaacaaattcaatatcctcccccttcaagaacaataaaaccccaaactgtgctatcattaaatactaccaaaaaccattaactagaaaaacacaatgcaaaatcattattcaagaacccattagaaaccacagtattctaaagtcttatagaaaagatgtgtttttactagttaagcattgatagaagtcccatcaaaaaaatgttcaatccaaatctgcatttttggctatggagttctagccaaactggacaggattaggcatccttacctgggctccttctacaaaatgacagtatgttttgaagctc

SEQ ID NO: 549 - DNA, 601 bp, Homo sapiens
tttgtttgatgcttttaatatcattatttgtgttacacgatacacaaccaaggatgatggtcaatactgcaatgaaaatgttaaaaaaaatattatacacggctcatgtcttccacacaccttcctggaaataaattagtgagcacggagaaacctggctgggtggcagccacagctgagagaggagggagtgttaaggcagtatctacaaggggaagggtggcaggagggcaagctaaggcctagattcttccctccaacctccctgacagggaaggagggagccacacatgcactgcctcagttggaagcccttgcctgccagaagctgccactgccagcttcctgcctctctctgccacacagaaatttctatgaagaaactctttcaggtataaaaggatcttcaacataatttcagctgctgttcattttctagttgaggaaactgaagacgagagaaagcaagtggcttgttgaagatcacagggaggggccagagctacaaccagaacccaggcttctgactcccggtccaaggctgtcagccattgcactgctgagccgccttctgcactgtaaacagaccacacaggcactt

SEQ ID NO: 550 - DNA, 319 bp, Homo sapiens
gtggcggaccggcctggcacccgctcactcgccccaagtctgagaaataaatacattcatcactgcacaaacatattgatacaaaaacaacactgttaagagtgtttgcaccgtctatgttggtaaggaccagacccagtcagccccttccgctgcctggggtggggttagggggccccaggagtggggacccaccagagtcgacagagctgcgcaaaggtcccggctttttggcttgagtgggaccctcgcatcaacccatccccaagggtcacgggcagagcagcagggggacccaagcccagactcgggtcctgtg

SEQ ID NO: 551 - DNA, 265 bp, Homo sapiens
gagatggaattttgctcttgtcacccaggctggagtgcaatggcgcgatctcacctcactgcaacctctgcctcccgtgtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtg

SEQ ID NO: 552 - DNA, 399 bp, Homo sapiens
agcggccgccctttttttttttttttttttttttttcctgtcatcagagggctgtttccctttataaaaggggaaaacaattgctttttaaatttcttttcttcttggagtctaagattttaaaagttgcagcccacatgtgaatccaaatttcctttgaaccatcaaatttgaatccctctaattcggatttcccattcaaatcatgtcagggcagttacttgttgaactttgtcctgaaatcctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaa

SEQ ID NO: 553 - DNA, 570 bp, Homo sapiens
atggccttgccctttgttttactgatggccctggtggtgctcaactgcaagtcaatctgttctctgggctgtgatctgcctcagacccacagcctgagtaacaggaggactttgatgataatggcacaaatgggaagaatctctcctttctcctgcctgaaggacagacatgactttggatttcctcaggaggagtttgatggcaaccagttccagaaggctcaagccatctctgtcctccatgagatgatccagcagaccttcaatctcttcagcacaaaggactcatctgctacttgggatgagacacttctagacaaattctacactgaactttaccagcagctgaatgacctggaagcctgtatgatgcaggaggttggagtggaagacactcctctgatgaatgtggactctatcctgactgtgagaaaatactttcaaagaatcaccctctatctgacagagaagaaatacagcccttgtgcatgggaggttgtcagagcagaaatcatgagatccttctctttatcagcaaacttgcaagaaagattaaggaggaaggaatga

SEQ ID NO: 554 - DNA, 411 bp, Homo sapiens
  misc_feature (399)..(399): n is a, c, g or t.
  misc_feature (405)..(405): n is a, c, g or t.
tttttttaacttagaatctaatctttattaacctgggatatcacagaaaatacttgggcctgccacttgtatttctttgtcctcaatactgaacactagacacatttgaaaccttcctcagaaggaaacaaaccaactggttatgcctgggtggtggcatggaagatgcccattgttgcccaatttgctaataagtattttgaaattaggaaatgaaacatgaggtccaagcctgtccagttccctacccaacccattcctcctccctggggaaaaaggaaacccgtattcatcttccaaatttctggattcatcactggccactttaaaaatggaaccgttttggaatttttaaaatgtggaattaactcaagtattcttttcttttggggatggccnaacctncggcca

SEQ ID NO: 555 - DNA, 463 bp, Homo sapiens
ttcttcttctcctttttttccagactcatttgcaacaattctttgattttcttcattttcactggattatttaatacctctcgttttttctcctcctccttcttcctgatgatgaagagtgggtcctcccggatcttgctggccatgtcaagaagggaattggcacctgatggggcaaagatagagcctgggagaagtcctgtttcagaagagcagcctgcctccttctcctccatcttctcaaaaacatatttgtcaatggggcgccccagcaggtactcgtcacggttcaccatcccaccaggaccctggtacatccagtacaacttttcttcttttttcctggttttgacggccccaacatcctccgcatagcgctgcatctcttcccgggctctctcttctcgcagctcccgctgaagctcctcaatcttcttccgctcagcctcatgcttctgctcgg

SEQ ID NO: 556 - DNA, 441 bp, Homo sapiens
  misc_feature (282)..(282): n is a, c, g or t.
  misc_feature (356)..(356): n is a, c, g or t.
  misc_feature (368)..(368): n is a, c, g or t.
  misc_feature (373)..(373): n is a, c, g or t.
  misc_feature (394)..(394): n is a, c, g or t.
  misc_feature (404)..(404): n is a, c, g or t.
  misc_feature (413)..(413): n is a, c, g or t.
  misc_feature (424)..(424): n is a, c, g or t.
  misc_feature (435)..(435): n is a, c, g or t.
tttttttttttttgagacagggtctcactctgtcacccaggctagagtacagtggcacaatctcggcttactgcaacctctgcctcccaggttcaagcgattctcctgcctcagcctcccgagtaactaggaccacaggcacacaccaccatgcccggctaatttttgcatttttagtagagacagggcttcaccatgttggccagggctggtctcaatttcttgacctcatgatccaccagcatcggcctcatgatgtgctggggattacagggcatgagncaacgcactcgggcctagtattcaattttacagggcagggccacctcttacctattttcacaggaaaaccagtntttacacaggancagtnaggaaccactggaattcagtnggtcttttcnggggggttntaggttcacantggatttaaantacagg

SEQ ID NO: 557 - DNA, 752 bp, Homo sapiens
  misc_feature (556)..(556): n is a, c, g or t.
  misc_feature (614)..(615): n is a, c, g or t.
  misc_feature (670)..(671): n is a, c, g or t.
  misc_feature (684)..(684): n is a, c, g or t.
  misc_feature (686)..(688): n is a, c, g or t.
  misc_feature (713)..(713): n is a, c, g or t.
tttttattcttaaccataattttattgaaggaaggaatcaatgaataaaaatttcctgagtttactgtttactgcaaaaagactgtatgctgttttacgttttcttcttttaaggtctaacatcaatatgttgatgtttggtaaatataatttcaatcccagttgcatctctgagtccaggcaagagtactacaaaaagtataaatagaggtcaagtgcagttgccctctgcaagcaagaccacttagaactcttcaatggctctttgacaaaccttcagtgggatttctgtcaaagctgacaatggataaaattatagaaaggagggaaagccttgataaggagtccttaatgagttcgtcactaagttaattcaacattgaaagggatagaagatgttaattccacacacacgtgaaagaaatcaacaatcaggcctcatcttttcaatgctaaaaccaggctttcctgtcggagttggggccagagatgtttccatcccctcttgcaaaaagggtattcttaagaggccttaagtcttcagcattgatagttnttgaaccagttggtgacggtcatcatcacatacagggaagctaggaagaacacgaagnntgagtaggagtagatgtagacggtgccctttcttctcgtcataaaatgacccgtnngtcccttcttccncnnngctgctgctctttcatgtcctctcncaccagactgaagcaaaaacaacagcgagctatctgcaa

SEQ ID NO: 558 - DNA, 412 bp, Homo sapiens
  misc_feature (166)..(169): n is a, c, g or t.
  misc_feature (174)..(174): n is a, c, g or t.
  misc_feature (176)..(176): n is a, c, g or t.
agacagggtttcaccatgttggccaggctggtctcaaactcccaacctcaaatgatccggccaccttggctcccaaaatgctggcattacaggcgtgacacacacacccggcttacatgcattttttatcaccacaaactgaaactctgtacccacttaaaaagannnncaaantncaaccctcaccccagaccctggtaaccactatttcactttctttctgaatttcccttcatatgagtgggatcaaacaagagttgtccttttggtgtttagcattcttacttagcaagccatcaactggctcgaacagtcactggggcaactacttttcgcccagtgtcctccagaaaagaaagatctgggagggtcaggccactcttttttcttcaaaataaatgggggtgcagaa

SEQ ID NO: 559 - DNA, 299 bp, Homo sapiens
  misc_feature (178)..(178): n is a, c, g or t.
ggattctccaccatcggcccccgcggtgaccagtgctcccgccccgtcccccttgcagggacagtgaatacaaacaaaaatagttctctacagaacgaagtttccaggccccccaccccttccttctctcctcctcccccagacggtgagttccgtggtcaccgggcctccgtgaggnctggggttctggtgggttgcaggaaaaataaagaatagaaaacaggaccaagtcagcgactggaattgtaggcaactggaggtcggggtccgccgccgcccgtgagcctggcacagccagg

SEQ ID NO: 560 - DNA, 484 bp, Homo sapiens
  misc_feature (82)..(82): n is a, c, g or t.
  misc_feature (139)..(139): n is a, c, g or t.
  misc_feature (449)..(449): n is a, c, g or t.
  misc_feature (469)..(469): n is a, c, g or t.
tttaggggaaaacattttaatatgtactatgaataatctcatctttataccaatatgtcttaaaatacattttttatggaangtgcagaggagggaggtccaaaagtgccaaaagcccatggaagtcacaatacatttnttcttttctccccacatgagtttctccatgttccaggaattttattatcagtctcagccttgctgttctgggcaggaagaaatgaaagaagaagaaaggaagccacgtctcctgaacactgccccgtgtgcccagcacagtgactgctgttgtgtagtcagcatctcttcggggaggacaggtgagtctccgagaagacatatccaatcagccgagcagcaattcaatcattgatctttaaaaaactagcccccaaaacataatgtcaagcagtggaaatggctatattggtcagggtataccccaatgncaagggtagtgctcaggggnccccagtatgactgg

SEQ ID NO: 561 - DNA, 379 bp, Homo sapiens
aacagagcgggcgcactaagaaactttttgtcatcagtaactacttttaacactttcagagttacagtacagcttaggggccaaaaattctaatcatgtaaattgcagggtcacattagataaaaacagtattgttcagtctataaactgacactaaaaatcatactgtacacaactgatgatacactgtacaaagaactaaggctgaaggatgggagccattcatgtcttttttccaaatttgtgttagtatggatggcagtattatatacttttcagtacttactgaaactaacgtcattaaggctacttgcaggattccttttgaatataaattaatataaatttagagtagaaaacagactagaattttcaagta

SEQ ID NO: 562 - DNA, 398 bp, Homo sapiens
  misc_feature (62)..(62): n is a, c, g or t.
  misc_feature (235)..(235): n is a, c, g or t.
  misc_feature (239)..(239): n is a, c, g or t.
  misc_feature (258)..(258): n is a, c, g or t.
  misc_feature (308)..(308): n is a, c, g or t.
  misc_feature (335)..(335): n is a, c, g or t.
  misc_feature (377)..(377): n is a, c, g or t.
  misc_feature (386)..(386): n is a, c, g or t.
  misc_feature (393)..(393): n is a, c, g or t.
atatccaagtggtgcctggaacaccagtgggacagaaccgttcactcccctggaaaggggantgaagccagggagccaagtgatctagctcagcagatcccacccctgcacatgtatcccagaacttaaagtataatttaaaaaaagaatgagtacaaaatgtcagatatatatcattgatgaatccttccaaaagaagagctgtgagtcagaattttatatgtcttatctctcngganatgaaaatactctgtagcntctatatctattattcagatcttgaatgtatggaagtagggcatttcctngcagataaacttgcttttgctttgacnctgtgtttgaaatagaaaatcattaatttgtaggcaacagtntcagaattngaaacanttaac

SEQ ID NO: 563 - DNA, 184 bp, Homo sapiens
gttgcagagatggtgaggatgtcttgctttgttacccaggttggtcttgaatttgtggctttaagtgatcctcccaccttggcctcccaaagtgctcgggttacaggcgtacaacagtgcctggcctgtattttattgtaattcctttttccattctcatctcaatgcatttccaaattagaga

SEQ ID NO: 564 - DNA, 413 bp, Homo sapiens
  misc_feature (357)..(357): n is a, c, g or t.
gtttttttttgttttgagagctggagtctcgctctgtcacccaggctggagtgcagtggtgcgatcttggctcactgcaacctccacctttgtgttcaagcaattctccttcctcagcctcctgagtagctgggattacaggcatgtgccaccatgcccggctaatgtttgtattttagtagagatggggttggttggccaggctggtcttgaactcctgatctcaagtgatacgcccatctcggtctcccaaagtgctgggattataagcgtgagccatggcacccagcctcacataggaaacttcttagagcaacttaaagttgttcaactatgttatacgtctttcttatgttntactaagtctagtacagtaaaacatatacaattaattattattaaaatcaccttaa

SEQ ID NO: 565 - DNA, 310 bp, Homo sapiens
ttgttgtttttttttgagacagggtcggctctgttgcccaggctagagtgcagtggtgtgatttcttctcagcaggtgcagacactgctctgaagaccaacagcagaactgagtctcaggatggggaaaggcttctgtaaacctccagatccacagccccaactactttcccttcaccctggctgaataccacatcttgaggcaatcaattacgaaaaggctgctcacactctctttttccgtaatgagactacttcagcccccttttatttggctactctaaattctccttttatagggatacaacagc

SEQ ID NO: 566 - DNA, 304 bp, Homo sapiens
  misc_feature (302)..(302): n is a, c, g or t.
tgtagagacaggcgcttactatgttgcccaggctcggttttaaactccaagcctcaagtgatcctcctgccttggattccaaagtgctgggattatagttgtgagccactgcgcccaacattcccatgacttttttgtgaaggaggcattcaccaagcttttcctaatctttaccataagccaggctctgcggtaaacaccccacaataaatgtttatcagaggacttagcagggaagtacattaaatgttaacgccttaatctgatactgaaaataaaagataatttcaacttggtttttnaa

SEQ ID NO: 567 - DNA, 451 bp, Homo sapiens
gagacagagtttcactcttgttgcccaggctggagtgcagtggcacaatctcggctcactgcaacctccgcctcctgggttcaaccaattctcctgccccagcctcctgagtagctgggattacaggcatgtgccaccacgcccagctaattttgtatttttagtagagatggggtttctccatgtttgtcaggctggtctttaactcctgacctcaggtgatccgcctgccttggcctcccaagtgctgggattacaggcgtgagccaccatgcccggctgcaatcacgtatgagtttttctaaaaaaaccgaaacactggaaacatggatgcatcttaaagactttatgctaagtgaaaccagtcacaaaaggacaaatactgtatgattccacttacatgagaaatatgagtagtgaagttgatgatagagacaaaaagtatggctgt

SEQ ID NO: 568 - DNA, 1973 bp, Homo sapiens
ggcggctcctttaggcagctgaaaggggatttaggcccggaagatccgagtccatccgcggcggggagagggcaagcgggaccggtagggcatgcagcggcggcgccgatcggacatgtcccatccgccccgtattgaggcgctgggagcgcggtgcgcgacaggaaagcgatggtgaaagcggggccgtgaggtgggcggcaggaacggccggacccgcagtagcgcagcagcggcgccgcctcccagagttcagacccaggaagcggccgggaggcaggagcgaatcgggccgccgccgccatggagctgagagtcgggaacaggtaccggctgggccggaagcatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccaggccgtctgcgggggacgcagggaatgtggctccccccacacccctcacccctacctcacacacggctaacacctccccccggcccgtctccggcatggagagagagcggaaagtgagtatgcggctgcacccggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaa

SEQ ID NO: 569 - DNA, 591 bp, Homo sapiens
ccgctgtcaagatgcttctggccatggtccttacctctgccctgctcctgtgctccgtggcaggccaggggtgtccaaccttggcggggatcctggacatcaacttcctcatcaacaagatgcaggaagatccagcttccaagtgccactgcagtgctaatgtgaccagttgtctctgtttgggcattccctctgacaactgcaccagaccatgcttcagtgagagactgtctcagatgaccaataccaccatgcaaacaagatacccactgattttcagtcgggtgaaaaaatcagttgaagtactaaagaacaacaagtgtccatatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaat

SEQ ID NO: 570 - DNA, 476 bp, Homo sapiens
tttttcatcggcaattatgacgtctgtatttatttatggacataaagaggcatgtgccaacaaaaaaagcatgttacaaagcaggatatatactattttttaaaatctataaatgtacagatgtaccgcaggttatgaaacacacaacagatacaaaattgttttatgcaaattgctccataaggtacataatttaattttagagatgtggacatttgtacatccagtgcaaggctaaatgtgggaaatgcacttcagagctccacagccccttccccatgcccctcactgggtcctcacctgtctccattacctgctgtgatctctgtgtgtcagccacgctaattccatgttgtttgtgtcatttcgcctttactgccttctaatttcaactggaaagtgctgataaggacagaggctagcagtctatttgaaggcgtaaagggaaagatacagcacccctagtacaaagttgg

SEQ ID NO: 571 - DNA, 394 bp, Homo sapiens
  misc_feature (10)..(10): n is a, c, g or t.
  misc_feature (58)..(58): n is a, c, g or t.
  misc_feature (333)..(333): n is a, c, g or t.
  misc_feature (342)..(342): n is a, c, g or t.
  misc_feature (377)..(377): n is a, c, g or t.
  misc_feature (384)..(384): n is a, c, g or t.
agatggcggntgcagatgctgctggaagaggaaatcccggggggccgccgggcttttntcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccagggcatcccagctacggaaggatgggaatcttcaatcaatcatattttcacaaacagttgatatttcataaaggggaaagtttgcaaggaagggggnaatttgggnatttttggacttaccccatttaaaaaccatttttnaaggggncacattaggg

SEQ ID NO: 572 - DNA, 468 bp, Homo sapiens
tttctaattgtttataacagtattttaatgggaaaacatatcctgagacttttcttcaaagcctcaaaatatataatgggcccattccaatcctccatccttggcagcaaaaacaggcatctgcctattcctgctgagacttctgtacaaacaaggtcgattttctcctgtcactgaagattatactgcagttgtggggccaatggaggggaatgacagcttccaaggcaaagtgtgagatctgatagtactctagaacttttctgggacatctttaagatctttggaacctctggagctggctgtagtcacctgaagcatctgatgggccaggcgcggtggctcactgggattacagaatcccagcactttgggaggccaaggcaggtggatcacgaggtcaggagatcgagaccatcctggctaacacggagtaaccccgtctgttataaggttttctgccatcag

SEQ ID NO: 573 - DNA, 281 bp, Homo sapiens
tttttttttttttttcgtagctcagttttattttctacagaaacaaacatgtaagccgtcctcctccagcgacaaacaatcaggcccccacaatgaactggccactcgtgctgggaccattccctaggggaggaggcatgacctaggaaggggcgccaggctgggcttagcgcctctgccctgagggaggctgagccaaaaacacgggcagaaagcactgcgtgatccacatcaacagggaaagctgctggagacaggagctgatggagagctgcagttgg

SEQ ID NO: 574 - DNA, 355 bp, Homo sapiens
ttttcaataaaggcagactttattgtgaatcacagcgcctggtgtatcctgaactttgaggagttatgggagggacacgttgggggaatgggaagggcaccattcaggccaattatggggaaacccctggaggagggtgaatgccgaaggaggaattgggggagtccaggggctccaagttaccactgtgacattttgagagaacccggggcttttgcagattctacaaaatgtgggccaagttcatcctgtccaagtgtgcagcagggcccttggcccccatcactatcctgcagcctggctgcctttccgtctctggctgcgctctttctccagcctcggtctggccgcactt

SEQ ID NO: 575 - DNA, 429 bp, Homo sapiens
catatgataatggaactttaattttttgaagaactctgccattttacatttccaccagcagtgtgcgacggttccaatttctccacgtctttgcccatacttgttattttctattgctttttttaaaaataatggtgtccttaaaatgagtttttaaagaaagaaaatgaaaacttataaacctatgaggacagaaagaatgaggagagacaacagcaaatgagagatgtcaacaaactcgtggatgatggcatgtgaatagatggttggctgagttgggtttcagtcttctgacgcgctatgcctgtggttaggagagtaggcaatgatgaagcaattggaagatgacatacttccagagcctgggttgcgaagtgaagctgaaaacttcccaccctgcgatggtcttccctcactcagtgtactaaa

SEQ ID NO: 576 - DNA, 482 bp, Homo sapiens
ttttttttttttgagatggcgtctcgctttgtcgcccaggctggagcgcagtggtgagatcttggctcacagcaacctccacatccccagttcaaacaattctgctgcctcagcctcccgagtagctgggaccacaggcgcatgccaccacacccggctaatttttgtatttttcagcagagatgggggttcaccatattggtcaggatggtctcgaactcctgacctcatggtccacccacctcagcctcccaaagtgctgggattacaggcgtgagccaccacgcccagccatcagcctgacttctatagtcttaatatttattaatcccataaaattaatcctttggttattcaaaaatatgaaaaggaaatatgattcttaggagtgcatcaaatggtttacatttttataggttgctttattggctctgacttttgcgtaatgaggttggtctattaaaagtgttttttctcacaga

SEQ ID NO: 577 - DNA, 439 bp, Homo sapiens
ggtagaggcaaagtttcgctatgttgcccaggctggtgtcgaattccaggcctcaggtgatcttcccaccttggcctcccaaagtgctgggattacaggcgtgaaccaccgtgccaaacctacatttttatatttattatttttttctgattaacaataaagctaggttattagctgcctgggaagaggaggaagtagatttttacattcacttttaaataaacttttaaattcacatgagaaattccaccttaccacaattgtctccctaacatgtctttggactacctctgtttctctaagtttttgtttttttctggtgtctgaattaagttggtgacagatttgggggatatttgagtagcactttatctagagttgcttgcacaaaagctgagtaggagcatagccctaatgagttcgcattaccgaaacaggt

SEQ ID NO: 578 - DNA, 432 bp, Homo sapiens
ttttgtagcgagggggtcttgctttataggccaggctggtattgaactcctgatttcaagcagtcctcctgtctgcctcccaaagtgctgggattacaagtgtgagccacagcacctgtcctagagtaattttttaataatatgatcgtggtcgaaaaagaccaaatttcttttacagtgaattagatgtgaactcacctatttttcctgtgaagcacatattatgatttgtcatttatctataggaaaaaggaaaggaatcccatggatatatttgatatggctagacatcggttgcaagctcctgtcagaagacagtcccctaagggcttagacgctgccacttttcagaatgttcatgattttaatgagctgaaagatagaggtgagtagattgctgctcttttaaagatgtagcagaagtgttctacc

SEQ ID NO: 579 - DNA, 401 bp, Homo sapiens
  misc_feature (285)..(285): n is a, c, g or t.
  misc_feature (291)..(291): n is a, c, g or t.
  misc_feature (382)..(382): n is a, c, g or t.
gagtcagctttaattgtgagttttggtgtgtgtgtgcgtgtgtgtgtgtgtgttttaatacggtgtctcattctgtcaggcaggctggagtgcagtggtgccatcatagctcactacagccttgatctcctgggctcaagtgatactcctgccttagcctcctgagtagctaggactacaggtgtacacaatctctcccaactaattttttttttaacttttatttttgtaggagatgggcatctccttttgttgccctgggcaaaaaaaaaaaaaattatgggntgatgncaatgtatttggggattaaatatggataaccattccttaataccttatattccccaccttactctgggggcctaaagggtttcatgcccanggggcccaagcaatttttt

SEQ ID NO: 580 - DNA, 417 bp, Homo sapiens
  misc_feature (21)..(21): n is a, c, g or t.
  misc_feature (95)..(95): n is a, c, g or t.
  misc_feature (100)..(100): n is a, c, g or t.
  misc_feature (103)..(103): n is a, c, g or t.
  misc_feature (150)..(150): n is a, c, g or t.
  misc_feature (153)..(153): n is a, c, g or t.
  misc_feature (162)..(162): n is a, c, g or t.
  misc_feature (412)..(412): n is a, c, g or t.
ttttttttttccggacaaatnccaaaggacctttttaaaaactaagagctctcgggcaggggcaggggcaggggcaggggagggggctagcagcncacancgnaagtcgaagtccaggaaggctgcctgctccgcggctgtgaggggccncgntcgggcggngctcagtgtgggggcctcccggtgaactcctcgtcgaagttgctgacgtcggtgcggccggacagcgtgggcacaaagggcggtggcaggcgcgggccaacagggcttcccagcccagagtcctgaagaagggctatttcttcacatcttctgcatctctctcgctagatcccagcctccgtttctgggttcctccgaagcagcctttcttcatggatgccgatggtttcggccgacaggaagtcggggntagcg

SEQ ID NO: 581 - DNA, 406 bp, Homo sapiens
  misc_feature (330)..(330): n is a, c, g or t.
ggaaaaaaaagctcatcagctagttaatgtattttacgtgtggcccaagacagttctagtgtggcccagggaagccaaaagatcggaccacccctgcaaacggttcttagatgaaaataaaatgtttggccctttatgactttaattgttcttggctgtcttataaattagttcctttattgaagtcactagaataagatacttaacggtttcctttttaagatgggaggtgggatgggaatgaggtgttagtataaactttgccaagtttgtagcctgcaaccttgttcaatgaaccccactgccctaaagatctgggggatggcagtntaggggggctgggactgaggtccatctgggaagggctagactttgagagtgcaaaaaggatgaaccagggcgcagg

SEQ ID NO: 582 - DNA, 259 bp, Homo sapiens
tttttacagaagaatttcaaatgtttaatgtagatattccctggtgaagacgattccgcctccaacgccttcttgaatgtgggctacacataatgacttgcttccaaaaagtagagtatgggaaggggaaaacgaagcgactttacagtggagaagcctgttggatgctgccatggccagtaattgttcacatcctcagtggaaagtcctgttgatgatgtgattgttgacacgatgtgatgagaaggccacttcacct

SEQ ID NO: 583 - DNA, 424 bp, Homo sapiens
tttttgattcaacagatatttattcatcaccaaatatattccaggagctggagacacatcagagaaaagagacacccatgcttgtcctcaatgcagcttatgttctaggggagctcaggtcaggagcacaggagagcagccagagatggacatctagatttggggttcatccacaggagtgagagaattgaaggtttgggtctgggtgggacaacctggaaacgtgtaggagggaagagaagagcagagggcctttgatggaacctggggcacacaggactcaaggaggaagaaaagctggcaaaggaggctgagaatgagtcgtcatctcccgcctgtgcccctcttagttctgcaagctgtggcctggatctgcttggaagtgtgttgaaggacaggcatgcaaaggtcccagggcatccag

SEQ ID NO: 584 - DNA, 395 bp, Homo sapiens
  misc_feature (359)..(359): n is a, c, g or t.
  misc_feature (393)..(393): n is a, c, g or t.
taaaaaataacaatctgaatgttttctctagggatggaagtaatataaccataatgcaagaagtctggtaaatgggtagaaagtcatctgatctaccaccacccaccacagccactgttatagttggtgtacttttttctcttttcgtacctgtactttcttatgatcacaacggatataatattaaaattatctggctttttatcctaaatcagccactttccttttggaactttttttttctttttcttttttttgtgaggcagagtttcactcttgtcacccagggctgggagtgcaatggccccaatcttgggctcactgcaaactccactgcactctagcctggggcaacaggnctgaggactctggtctccaaaaataaataaatanat

SEQ ID NO: 585 - DNA, 362 bp, Homo sapiens
aatatgtatttctttcaaagtaaaatttaattttatatgtccaaaatcaatcaggtacttgacaatgaagaaaaattcacacaattttaaaataaagatttttacaggccatgttttctgctcataatccaataaaactagatatacaaagttaaaaaaatcaaaagattcctaaatgctagaaattaagaaacccattattaaataatcctcaaacaaccaaagaggaataaaaattaaaattacaaactattttaaaaatgataaatgtagactcctttattctaaaacctatagtatccagctaaagctgtactcaggagaaaattaatagctgtaaatggctttgttgttagaaagac

SEQ ID NO: 586 - DNA, 232 bp, Homo sapiens
ttgagacgaagtgtcgctcttgttgcccagcctggagtgcaatagcgcaatctccacccactgcatcctccacctcctgggctcaagtgattctcccgcctgagcctcccgagtagctaggactacaggcgcccaccaccgggcccagctaattttttgtatttttagtagagatggggtttcaccatgttggccaggctggtctggaacttctgacctcaggtgatccacc

SEQ ID NO: 587 - DNA, 439 bp, Homo sapiens
tgtcagcaactgttcacagcccaggaggcgtacctgcagtgtccctgttagggcggtgggcttcacaggtgtccctgaaggctgggggtatccaggcaccgcagcccgcaactctcgggtcactctgctgcgcaaagggtgggcaggaggcagttgctccagcagctgctccaaggccaggcgcaggaggtccagtttctgagaggactcctgtagctgggcctgggctcagccagtgccttgcggtcctgtgttctccggctactaagcagtttcaccacgttcttggcgccctcagccacagctgcctcaacgtgcagtcgatgctgtagctcctccgccagcagctcaggccctggctccggggacccactggcctccaggctgctgatcttcatccgcagcagggccaccttcagctggctgtccccctcgtgcc

SEQ ID NO: 588 - DNA, 513 bp, Homo sapiens
  misc_feature (27)..(27): n is a, c, g or t.
  misc_feature (346)..(346): n is a, c, g or t.
  misc_feature (375)..(375): n is a, c, g or t.
  misc_feature (420)..(420): n is a, c, g or t.
  misc_feature (428)..(428): n is a, c, g or t.
  misc_feature (456)..(456): n is a, c, g or t.
  misc_feature (465)..(465): n is a, c, g or t.
ggtctgcttctgatgcttagattacangtgcagagttcatccacgttgtgacttgcatcaatactccttttcatggctggataatactcagtttgatggatgtaccatattttgtttatccattcatcagttgatgggcacttggattattttctactttttgactgttgtgaataatgctgcagtgaatatttgtgtacaggtttttgtataaacacgtttttatttctcttggctgtatacctaggtgatgggaattgctgggattataagggtaactttttttgttgttttttgaggatgggagtcttgcttgtcaccagggctgggagtgcagtgccgaganctcggctcactgggaccctccatctcccngggttcaagccgattcccctgcctcagcctcccaagaggctgggnctgcaggnacggaccaccatgtcccggcaatttttngatttaggnggagatgggggttcaccatgttggccggatgggctcaactcctgcctc

SEQ ID NO: 589 - DNA, 415 bp, Homo sapiens
ttatgctggagattgtaatggttagaaatgtacaaattaatcctagaatgacttgtcttaccatatagcaaagaagtcactaaggattaattgatcaaagatgagacaatttgagcatcaataagaaaaataactacaatggactgaaacacataccttttaaatccacagctcattaagaatgggactaaaaaggccaggcgtggtggctcacgcatgtaatgccagcactttgggagggtgaggcaggtggatcacctgaggtcgggagctcgagaccagcctgaccaacatggcgaaaccccatctctactaaaaatacaaaattggccgggcatgttggcacatgcctgtaatctcagctactcaggaggctgaggcaggagaatcgcttgaacctgggaggcagaggttg

SEQ ID NO: 590 - DNA, 192 bp, Homo sapiens
gggcgtctccctatgttacccaggctggtcttgaagtcctgggctcaagcaatgctcctgcctcagcctcccaaagtactgggattatgggcatgagcactgccctgcacccagtcagaaatgcttctcttgaataagcagttattagaggaattaaacattcaagaaccctaacatgcccccaaacatcgt

SEQ ID NO: 591 - DNA, 394 bp, Homo sapiens
ttttttggagacggagtcgtccccgtcacccaagctggaacgcatggtgtggatctcggctcactgcaaactctgcctcccaggtttaagtgattctcctgccccagcctcccaagtagctgggattacagaagcgcgccactacacccagctaatttttgtatttttagtagagacagggtttcagtatgttggtcaggctggtctcgaactcttgacctagtgatccacccgcctcggcctcccaaagtgctgggattacaggcgtgcgactgcgtccggcctgattcacatatattttaagagactaaacataggaaagctaggagatcttgtgtggtggcaggtttcttctgccactcaggggtaggacactggggcagggggagtggcc

SEQ ID NO: 592 - DNA, 501 bp, Homo sapiens
tcttcgcttggaagaaagcgtgagatcacgctttgttttcttttgttgtttgttttgttttttttttctgagggaagccttagcttaatgtatgccggtccttcaaaagacatgatagcaatttgagagtctgaactgtaagtttttgttactttattcgttcaccaaatgtttttatggaagccttgccacgtggaacatgtgtcccgggttttaaaaaatgaatttgactcaccagctaacactgaaaaaataatgtacagcctagaaggaaagatcaaagtgtaaaagtggttagtcctgtcgcctcctgagcatttttgtattatatcacttggtttttcgtctgaagtggctgtaaataatcgtattaaaaatcttctggtccagacgcaggaaaaccttttccggtataaagcccaccttcctctaatgttgcgcatgcccactgtgcccagctgctccgctttcgtgcatcccagacttctgtcaccaggtaag

SEQ ID NO: 593 - DNA, 1540 bp, Homo sapiens
cgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccg

SEQ ID NO: 594 - DNA, 447 bp, Homo sapiens
  misc_feature (12)..(12): n is a, c, g or t.
  misc_feature (384)..(384): n is a, c, g or t.
  misc_feature (399)..(399): n is a, c, g or t.
  misc_feature (408)..(408): n is a, c, g or t.
  misc_feature (421)..(421): n is a, c, g or t.
tttttttttgcnttttgttttttgagatggagttttgcacttgttgcccaggctggagtgcaatggcacaatctcagcccactgcaacccccgccttccaggttcaagtgattctcccgcctcagcctcccgagcagctgggactacagacatgcgccactgtgcccaactaatttttgtattttcagtagtgtgagatttcaccatgttggtcaggctggtctcgaactcctgacctcaggtgatctgcccgccttgacttcccaaagtgctgggatcaaaggcgtgacaattcacacccggccctaaattcatacttttaaggcttctctatgggaccctttgaaacaactttaactgggtcttccttctaaggaggtttgnctttcttcctctagntccgtgttnccacaacagtagncctggatttattttttcccaaaaaaa

SEQ ID NO: 595 - DNA, 473 bp, Homo sapiens
  misc_feature (316)..(316): n is a, c, g or t.
  misc_feature (340)..(340): n is a, c, g or t.
  misc_feature (364)..(364): n is a, c, g or t.
  misc_feature (400)..(400): n is a, c, g or t.
  misc_feature (416)..(416): n is a, c, g or t.
  misc_feature (431)..(431): n is a, c, g or t.
  misc_feature (472)..(472): n is a, c, g or t.
ttttttttttttccatgttcatttttatttaaagactcagaaacacaggcatcatggtttgtcatcactgacaagtcttccaaaatcacacgctgacatttgtgtctaacaaaaacacttgggatagggtgtgtgtgtttgtgtgtgtgaactgtgcaaagtacaaaggatctcccagtcggctgagcctgttttgaagtgcccggcctggcatcaccccatgaggatgccagggagagcacccgtgggccgccatcctctctgcctccctctgggcagaggccctgggtgggctggcagtcctgtcccctcggtntccacttgacttcagccatgggtngtgggacttttaccatgcttcctnaaagggaaattttcttttggggccccccaagggcanttacatggggttaagntgttgtaacatcatnggggggccagggtttgaaacattaaggggtttaattttcant

SEQ ID NO: 596 - DNA, 454 bp, Homo sapiens
cagaaagaaagaagtaaaattatatttgtttgtagacgacatgatcttctgtgcagaaaatcacaaagagtcaaccaaaatactactggaactaagtaacatattcagtggatttgcacaatacagtatcagcaccaaaaattagttgaatttccatacttttaacaataaacaactttaaaagaaaattttaaaacacttccattggctggagaacttaaagtaagaaatacttagaaataaacgtaaaaaggtcagaggtttttaccttgaaatctacaaacattgatcaaaatgattagaaacatagagctacaacccatacttatggtttggaaaaattaatattgttaaatgattatataacccaatgtgatttagattcaacacggtacccataaaaatccttatcacttgggctgggcgcagtggctcacgcccgcaatcccagcac

SEQ ID NO: 597 - DNA, 386 bp, Homo sapiens
aaaccaagtctcgctctgtcgccaggctggagtgtagtggcatgatctcaccacactgcaacctctgcctcccgggttcaaacgattctcctgcctcagcctctcaagtagctgggactacaggcatgtgccaacacacccagctaatttttgcactttcagtagagatggggtttcactatgttggtcactatggtcttgatctcttgatctcgtgatctacccaccttgggttcccaaaatgttgggattacaggtgtgagccactgcaccaggcaaactgcgatcttttagtggtgcctcttctctcttttgacttaaggatgttgtcccttaaggaaacctggaggctactactgtgatacactacttgagagatggattgt

SEQ ID NO: 598 - DNA, 256 bp, Homo sapiens
tttttttttcttagatggggtcttgctgtgttgcccaggctacgctcaaattcttgggtttaagcaatcctccggcctcagcctctcaagtagctgggattgcaggctgcatccgcacccagctcctaacaattttttttccccctcttattgagccagggtctcactctgtcacccaggctggagtgcaggggtgcaatcatggctcactgcagccttgacctcccaggctcaagtgattctcccacacaggtgg

SEQ ID NO: 599 - DNA, 273 bp, Homo sapiens
ttttttttttttttttttttgggacggagttcgctctgtcgcccaggctggagcgcactggtgcaatctcagcttgctacaccctctacctcccgggtgtcaccatgttggccaggctggttttgaacttctgactcaagtgatctgcacacctcagcctttaaagtgctaggattacaagcatgagccaccacacctgctccttctatttcattttaacataaataagtaatagtagctaagacttactaagcactatgtattagacagttt

SEQ ID NO: 600 - DNA, 386 bp, Homo sapiens
  misc_feature (231)..(231): n is a, c, g or t.
  misc_feature (365)..(365): n is a, c, g or t.
gcctctgttgctcagcctggagtgcagtggcgcagtcacagctcctgggcaggtgatcctgtcacctcagcctcccaagtagctgggactacaggcaagcaccaccataacctggctaattttttgtattgagacaggatctccctatgttgcctaggctggtctagaactcctgggctcaggtgatcctcccaccttggcctcccaaggtactggtattgcaggcgtgantacctgaggaaatgacctttagtaagccttccaaaagctatgaactccagtttccatataaataagtctttagttttagtagagtggggatttgttttgttttactgttgtgtgcccagcactctaaaatgggnatctgaatatgataactgttt

SEQ ID NO: 601 - DNA, 429 bp, Homo sapiens
tttatttttatttcctttctttagctctagtccctcttccttctcttttttaatttagcattggtgattttagattgtttttagcctactttttaaattgtgtattgtattgtaagcattttcaagaacagaagaggatcttttaaaaaatattatttcttgatctctgtcacggtccgttcaaagagggccaaataggaacagctcccttctgcagctcccagcgtgaacaaagcagaagacaggtgatttctgcacttccaactgaggtacctggttcatctcattgggactggttggacagtgggtacagcccacagagggtgaggcgaagcacggcggtgtgttgcctcactcaggaagtgcaaggcgtctgggaatctccctcgtcaggccaagggaagccgtgacagactgtacatggaaaaa

SEQ ID NO: 602 - DNA, 475 bp, Homo sapiens
taaagatgctgcaacttaagtccctagaagcatttacctatacctgtctcttaagagcaaagatataaggtcaattctagttgtaactcagaaaaatctgtcacagatcagacagcttgacagtcatgagtgctctctctcctggcatcctactcctccacttttaccccagcatccatgttttggtctcttcgtatgggtcaaacttcaactttataaaaatagtgaataccacttattgagtgcttagagtgtaccaggcatggtgctaaacactctctatccattatctcattaaatcacatgacactatgagaaatgtactattcttatacccacgttgcccagggtcatacatctaaggggtgcaaggaccaggctttgatttcaaattataatctaatgctcactctcccaggccttgaatgtcacagcagctcctcattcctaatacttaacaatagtgaatgtgcag

SEQ ID NO: 603 - DNA, 393 bp, Homo sapiens
ggagacggagtcttgctctgtcaccaaggctggagtgcagtggcacgatcttggcttactgcaacctctgcctcctgggttcaagcaattctcctgcctcagcctcccaagtagctgggactacaggcgcacgcccccacacccagctaatttttgtatttctagtagagacggggtttcaccatgttggccaggatggtctcaatcttttgacctcatgatccacccgcctcggcgtcccaaagcgttgggattacaggcatgagccaccgcacccggcctcacttcaagaattttttacaagcacagaaactatatctcagtgtatgataactgttactataatactatattgtattataaatatacaagctcatttgagtgtgtgatagc

SEQ ID NO: 604 - DNA, 874 bp, Homo sapiens
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaagcaggccctcatgctgtaaagaagttgagttctggaaactccaagttatcatcgtccaagtttagcaatcccatcagcagcagtaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataacttttaaataaaccttggggggtgatgga

SEQ ID NO: 605 - DNA, 351 bp, Homo sapiens
tttggtctctctttttatatttattaacttttgtagtaaataagtataattttataaattgtctgaacagaatgggcatggtggctcatgcctgtaatgccaacacatccagccttgtatgtgttcttgaccggcatatattgttagtgtgcatgtattttaactgatataaatgataagttccctattgctatgtgaacatataatccattactttgaatcactacacattttcacattttacttaccttccccatacagacttccaattcctgcccccaacaattaatattgtgaccagcatccatactgtgcctcttgcggtcctctgtgagagcttcctgagagacg

SEQ ID NO: 606 - DNA, 1124 bp, Homo sapiens
tccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaa

SEQ ID NO: 607 - DNA, 481 bp, Homo sapiens
gagatggagtctcactctgtcacccaggctggagtgtagtgctgcgatcctgactcactgcaacctccacctctggagttcaggcgattctcctgcctcagccttccgagtacctgggaatacaggaatgcaccaccatgcccggcgaatttttgtatttttagtagagacggagttccgccatgctggccaggctggtctcgaactcctgatctcaggtgacccacccgcctcagtctcccaatagattagatatattattaacgaattgcttcctttaacacgctattcattgaattttccagtaaaccacaattactaattactcctgaaatcagaaaagaggttaaaaagattttataacagtatcttatgaaatctactactttcaagtaatagtagttgaattaccaaaacccgtcactcaagccaatgactacaattaagatatcagtaatatttcctagataaataaagtcaa

SEQ ID NO: 608 - DNA, 510 bp, Homo sapiens
aattagctgggcatggtggtgcacacctatagtcctaactacttaggaggctgaggtgggacgactgcttgagccgaggagtttgaaggcaatagagagagactctgtttcaaagaaataaaatgtaaagacaaatttctccttcctcttcaaatatgagaatcatcatagccctccctaactcctatattttttagattaatcaaactcagatttctcaaacattctagaacacaacttgatcttgcctcccaagattaacccttccagaactttttaactttgttaaagtgcctgtctttccatctttttaaaatagagcttatcaaagaatttctgtgaaagtttccctttgcttcctcaccggaatgatctgtgatcacattaggattccatctttgaaaactactatctaagccatctttccattttaagatttctgaatacaaaaaaaaaatccctttttcttaatttctctaaaattcactgacttaatgggtcttattcttt

SEQ ID NO: 609 - DNA, 418 bp, Homo sapiens
gtatttatttatttatttatttatttagagacagagtctcgctctgtcgcctaggggggtgcagtggcgcaatctcagctcactgcaacctccacctcccgggttcaagcgattctcctgcctcagcctcctgagtagctgggattacaggcgtgtgccaccatgcccagctaattttttgtatttttagtagagacagggtttcaccgtgttagccagggtggtcttgatctcctgacctcatgatccgtccgcctcagcctcccagagtgctgggattacaggcatgagccactgcgcctggcccaatttatttttttttgtagtttcattctcctcacatccaaacagctacagcttccctccttttgtggggtccccaaaccaagtctcttttcaggagagcagacatgtgcct

SEQ ID NO: 610 - DNA, 1124 bp, Homo sapiens
gccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaaaaaaaaa

SEQ ID NO: 611 - DNA, 410 bp, Homo sapiens
aaaatatcagctttattaccaaggatgactgtgctgcaggaggcggctcagtgtgaagaactacgggtttcctgatgttgaagctcagaattagccacactgaccttctcagtcatgcatgatgccaggaaaatcacaggcttccattctacagtgaagggcttggaggagcaggcaataatctgtagtccccagctacttggaggcagtggacgggaagatggcttgagcccacggagttccaagttgtagtgcactatcatcatgccactgcatctgcactccagcctgggtgacagaatgaaactctgtgtctccattccccgtggtttgcttggtttggtttgatttgggtctggtcttactactgctgcctctccgtttgactggcaaagtgtggactgggcact

SEQ ID NO: 612 - DNA, 498 bp, Homo sapiens
gcgcctgctctccatccaggccccattccggctcccacccgacgctgcttttgttcccacgtttcggggggcagctggcactgtgattcctgccccatgagtgcctagaggaggacgccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggccccggagcttgaggatgccgactttctcctggagagctacctgaacctggcacgcagcaacgagaaactgtggaggtttcacaagaccatctcctactggaagacctgcctttgggtgccc

SEQ ID NO: 613 - DNA, 408 bp, Homo sapiens
tttaaagctagttttactttggtttttatttttaattcaattctgttcaggatgctgattagaaaacctccatatatgagaaacagtgagaggcaaactcttttgtgccgtagaatgttctcgacatcaaaaaagagcactggaagccttcaacatttcctgtttatgttgcacagatcagaggttcacacagaaaccacctgcccacgtggcccctgctgctggtttcccaagccccagctttcctctgcagtcccctcttgcactgctttcttctgatgaagtctggcgaagtccattccaaggtttgttacactgcgtgtcctgccttcttctttcgtttttgcctcacaggttctgaaagaagtaattgcctagagtctctgaatttaaccagtttttaaaagg

SEQ ID NO: 614 - DNA, 372 bp, Homo sapiens
agcggccgccctttttttttttttttttttgagacggagtttcactcttgttgcccaggctggagtgcaatggcgtgatcttggctcactgcaacctccacctcccaggttcaagtgattctcctgcctcagcttcccaagtagctgggattacaggcatgtgccaccacaccaggctacttttgtatttttagtggagatggagtttttccatgttggccaggctggtctcaacctcctgacctcaagtgatccacctgccccagcctcccaaagtgctgggattacaggcatgagtcactgcgcccagctcccaaagccaattttcaattatttgtgagccatagattcagtgactacatcaatatctct

SEQ ID NO: 615 - DNA, 344 bp, Homo sapiens
  misc_feature (287)..(287): n is a, c, g or t.
  misc_feature (340)..(340): n is a, c, g or t.
ttttttttgagtcgtctttgcattcttttatttctgtttcatctacacccaaggcgaatctgatgggttctcccttccaaacagggtggggggtctgacgctcctctgcctggctacagccccggatgtgttaaatgtctgcatctcgcacctcccgttccaaaaaacgtcacggagctctgagccactgcttccctgaaaccatcgttcccacgtcaccgatggcccccaccggccaaatcagagggcctggctggtcggcaccttccagggccttccacaacctnctgccccggctcctgcttcaaacactcctcacgttgcctatgagacactgcanaccc

SEQ ID NO: 616 - DNA, 413 bp, Homo sapiens
cgtgtgaataaacgattttcctttatgtggaatggttcagagaacgtgggcgtgtgcacacaagtgccctgttccggagtctggtgggtgggggttctagcaggctcctctcctgcgcagggggtctggggctgcggcctcactgactgccttggtcctcctctgtgcgctggtcctctgctgctctttatggaaaatgtttcctgaagatcttccaatattttgaaggatttggtccagaatggatagattttcatactgagtgttctttgaattcttttctttactggaaacactcttctcactgccaggagacacctgtggcccacgataattctcagaaggatcgccatggagatttgcattagcattggcttcatcattggaaattttgtcctcaatgccaggagaga

SEQ ID NO: 617 - DNA, 487 bp, Homo sapiens
  misc_feature (32)..(32): n is a, c, g or t.
  misc_feature (39)..(39): n is a, c, g or t.
  misc_feature (51)..(51): n is a, c, g or t.
  misc_feature (454)..(454): n is a, c, g or t.
  misc_feature (487)..(487): n is a, c, g or t.
ttttttttttgaaatgggatgtcattctgagnactcagnaaacccctgagncttgttagatggacagacatcctttccatcttatgtggatgagtgtttcttcagtgtctttagtatcaatttacccagatactgattttgaaagcctcattcacaccataaactttgttctaaacctctgtcttttacattgtccttctccaatgccttacctcttagttacgattctgaaaccaagagtacatctcaagtatgtaggctgcaatgggagctctgcttcacgactgtaggctagtgtttaatgctgagtaaaaaatgtgccttaaagggtagcctgagtcctgttcatcaaaataatcacatggctgggctgagggaccctcaaggctggatggacagtgtttcccaagtttaaacaggcccaactaaaaatttttttctcccttatttgggnttttgaggaaaccttacaaaatcctggggctan

SEQ ID NO: 618 - DNA, 436 bp, Homo sapiens
  misc_feature (5)..(5): n is a, c, g or t.
  misc_feature (12)..(12): n is a, c, g or t.
  misc_feature (382)..(382): n is a, c, g or t.
  misc_feature (420)..(420): n is a, c, g or t.
tttgnatagagncttgctctgtcagccaagctggagtgcagaggccaacctcagctcactggaacctccgcctcccgggttgaagcaattctcatgcctcaacttcccaagtagctgggattacaggcacccaccactatgcccggctaatttttgtatttttagtagagatggggtttcaccattttggccgggcagatctcaaactcttgacctcaagtgatccacccaccttgtggtgctgggattacaggcgtgcacccgtgtcctgtctcctgttggctcgtttcttttacttgatttttttcctcttggcttttgatcatttattttgcttcttaatatgactggataattttttattgaaatcagggatatgggnatgtgaaaattttcagagataattccagactctagganggggttactgctaggc

SEQ ID NO: 619 - DNA, 408 bp, Homo sapiens
tttctagtttgggataatttattgtatagcaatgcataactgacacactattcaaaatcaaaaagaaaacaataactcaataaataacatggtgaaaaaaatatgaacaaataattcacaaaagaggaaacatggttagatgacaaagacacaaaaaaaagactcaacctcatttatatataccagaaatcaggtagatacaaatgaaagcaacagcctaagaccattgtacacttacctttttgtcaagaacttaaaactcttaatagcaaatattgagagatgcaagctacagtcatggttaagagggcaggctcaggggccaggctgccaggcatctaattctagttccactcacaaactttgtggccttgagcaaataatataagctttgtatacttcgatctc

SEQ ID NO: 620 - DNA, 445 bp, Homo sapiens
gagagggagtttcgctcttgttgcccatgctggagtgcaatggccgatcttggcccactgcaacctccatctcctgggttcaagcgatcttcccgcctcagccttccaagtagctgggattacagacgtgtgccatcaggcctggctaattttgtatttttagtagagacagggtttcgccatgttggtcaggatggtctcgaactcctgacctcaactgatccacccgcctcagcctcccaaagtgctaggattacaggtgtgagccactgcacccggccctgcccccagtcttgaccattctactaattttaaagaacatcttggaattttacactcttggaatcatagtcgtagaatcctttttttgagacagagtctcactctgtcgcccaggctggagtgcagtggccagatctcagctcactgaaacctcagcctccca

SEQ ID NO: 621 - DNA, 311 bp, Homo sapiens
  misc_feature (64)..(64): n is a, c, g or t.
ttttttttttttttttttttttttttttttatttagagatggggttttgctctgttgcccaggntggagtgcagtggcatgatcatagctcacagcagcctctaactcatgggctcaagcaactcttacacttcagcctccaaagtagctgggactacaggcatgagaaaccacacttggctaacacacacacacacacacacacacacacacacataattgctatcatctctatcaaatatacacatatatttgatatatatgtatatttgtgtgtgtgtgtgtgtgtgtatatatatatatatatatgt

SEQ ID NO: 622 - DNA, 397 bp, Homo sapiens
tttttttttttttttgagacgtagtctttctctgtcacctaggttgaagtgcagtggtgcaatcttggctcactgcaacctccacctcccaggttgaagcgattctcctgcctcagcctcctgagtagctgggattacaggcatgcaccatcacacctgactttgtatttttagtagagacggggtttcgccatgttgccaggctggtctcaaactcctgagctcagccaatctgcccgccttggcctcccaaaatgctgggattacaggcgtgacactagtgcctggcctggtctttcagtaccatatacaagcctgcaataaatctgtttagacataatgtcatagaagtgagtgtatctgtgggacaaatccctagaattgctgggtcaaaggg

SEQ ID NO: 623 - DNA, 446 bp, Homo sapiens
tgagacggagtcttagttgtccaggctggagtgcagtggtacgatctcagctcactgcaaccactgactcccaggttcaagcaattcttctgtgtcagcctcctgaggagttggggctgcaggcaagtgccaccacgcctggctaacttttgtatttttagtagagacggggtttcaccatatcgctcaggctggtctcaaacttctgacctcatgacctgcccgcctctacctcccaaagtgttgggattacaggcgtgagctaccacgcctggccagaactatcatttgattcagaaatctcatcattgggtatctacccaaagaaaaatagtttattatatgaaaatgatacgtatacttgcacatttattgcagcatgctcacaacagcaaactgtatatatcagaaaagcttaatattcaaaatatatagaaaattcaaag

SEQ ID NO: 624 - DNA, 511 bp, Homo sapiens
ggctggagagaggcgcaggcgcgaagtgtacatgaagtccaatagaggggcgaagcctctcgcttcgggacccccgggcagagagagcacgtccaccccgactcccgcacggccccggaaaattgaatagaagaagccactgcaggcgatgagaactgccttgtgtgctctgaggggttgcccgccaaccagcagcgtgacgtcagtgaggatcccgcgcaggcgcagctcgttgaggttgcccagcacgtcggaggagtggcgagtgaactcggacgtagcccagcgctccctccggggcggcgggggaacccatagcgacacaggcctgtagaggccgtggaaagtgctctggatccaggcagtcctaagacgccttccctcctctgtttgccttttccttccgaggtgcaactagagccaggacttccagcccctagccccggcacacgcagcctccctcctaattcttcttgttcattctgccctctacgacaccctcgctcccttg

SEQ ID NO: 625 - DNA, 533 bp, Homo sapiens
ctaagtatttttaaacttgcatacaatcagttattttaattctctgtgtatacaggcatatctcattttattgtgctttgctttattgtgctttgcagatattagctttttttttttttttaaggaacagtgttttgctctgttgtctaggctgtaatacaggtggtatgatcatagctaattgtaacctcaatctcctaggctccagtcatcctcctgattttgcctcccaaagcgctggaattataggcatgagccactgcacccagctagatattgcattttttacaaattgaaggtttggggcaactctaccatcagcaggtctattggtaccattttcccaaaagcatgtgctcacattgtgtccttgtaccacattttggtaattctcacaatatttcaaactttctcatcattattatatctgttatggtcatctgtgatcaatgatctttgatgttacttcataattttgagggtgagctacaaaccacacctatataagatagcagacttaacccacaaatgtt

SEQ ID NO: 626 - DNA, 475 bp, Homo sapiens
  misc_feature (346)..(346): n is a, c, g or t.
  misc_feature (450)..(450): n is a, c, g or t.
  misc_feature (456)..(456): n is a, c, g or t.
  misc_feature (468)..(468): n is a, c, g or t.
tttatccttcagcaagcctcttttaatgatttaaaaaagaactactaacttttacaaataattgtgttcagagacagactttcaatctaaagaaaagatcaaggacctagctctcgtggcagaatgcagaaacagaagcctccagattgatctctgcagatgctaacgtggcccactttgtcctcatattcagcctgatcctaaagcccttacaactaagccaatacctgcttggattcttctgacaactggcaaagatgtcacgttccacttcttatctcaccacctcttaaccacaaattggccccagtggctttcaaaagggggaaaaaattgtgcgagtttnagactgtttatgtattcatgactaaaaccaaatctggagatctttggaactcttagctggccctggggcatggcgaagccgcctgtgcatccccttgggtccanctgganggccgtgaagancttcagt

SEQ ID NO: 627 - DNA, 3868 bp, Homo sapiens
ggaggtcttgtttccggaagatgttgcaaggctgtggtgaaggcaggtgcagcctagcctcctgctcaagctacaccctggccctccacgcatgaggccctgcagaactctggagatggtgcctacaagggcagaaaaggacaagtcggcagccgctgtcctgagggcaccagctgtggtgcaggagccaagacctgagggtggaagtgtcctcttagaatggggagtgcccagcaaggtgtacccgctactggtgctatccagaattcccatctctccctgctctctgcctgagctctgggccttagctcctccctgggcttggtagaggacaggtgtgaggccctcatgggatgtaggctgtctgagaggggagtggaaagaggaaggggtgaaggagctgtctgccatttgactatgcaaatggcctttgactcatgggaccctgtcctcctcactgggggcagggtggagtggagggggagctactaggctggtataaaaatcttacttcctctattctctgagccgctgctgcccctgtgggaagggacctcgagtgtgaagcatccttccctgtagctgctgtccagtctgcccgccagaccctctggagaagcccctgccccccagcatgggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccacgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctatgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggc

SEQ ID NO: 628 - DNA, 392 bp, Homo sapiens
  misc_feature (8)..(10): n is a, c, g or t.
  misc_feature (12)..(12): n is a, c, g or t.
  misc_feature (202)..(202): n is a, c, g or t.
agaagatnnntntcctggatgctttgcaaatagctagggagagcaacagaagctacaagtgagtctggttatgacacaggactctttcggtgccactttgccagccagagacctccacggccggcaacgccctgcgcaaggcctcacggctccaggctgttggaggtacctgcccactcaacctgggctggctgttggaggnacctgcccactcaacctggcgggctgtgcgtggcttgtgctttgggctggatcccacgctcgccatgggatctgcactcggactgcagctgggccgggcatgccatgaacctggcttccaccttgggtgccgacgtttggatgagaggaacatggtgggcgcctgaaaaatctggagacaccagaaaccc

SEQ ID NO: 629 - DNA, 498 bp, Homo sapiens
  misc_feature (33)..(33): n is a, c, g or t.
  misc_feature (298)..(298): n is a, c, g or t.
  misc_feature (328)..(328): n is a, c, g or t.
  misc_feature (426)..(426): n is a, c, g or t.
  misc_feature (479)..(479): n is a, c, g or t.
  misc_feature (487)..(487): n is a, c, g or t.
tttttaagtagagatggggttttgccatgttgncagggtggtctcaaactcatagcctcatgtaatccacctgcctcgacttccaaaagtgctgggattacaggtgtgagccactgtgaccagcctgacttcaaatcctgtgttgaatagaagtagtgagatcgggcatccttctcttattcctgatcttggaggcaaagatttcagtctttcacctaaaatgactgaaagactttcagccatgggctttgcatgactggcctttattttgttgctgtacattccttcttttcctggntttgggagtgttttaccaggggaaagggtnttcaaggctgggggcaccgtgggcctcaagccttgcaaattgcccagcacttttggggagggccaagggtggggcgctccgtgcccaatttcttgggncctcgagggccaaaatttccccaataagtgaaggccgtattttaaaattccgnaaatcaangtcaaaaggct

SEQ ID NO: 630 - DNA, 531 bp, Homo sapiens
ttttttggatcagccaagctagaaaactgaattagctttcaattctgtctctataaattgagaatggcaatgaggtcatggacacagcctatggtcccttaaaagccagcagcattctccttccacacacccagtgctcaggttcaggaatcttcgctgagactgggcccctggtgctgagatcctagcccttagatacaacatgcagccagcctctgctgatgcttcccggaaactgctgctgagcagtgtgagattccctgtggctccccctttctccatccaggggaatttctggagagaattaccatttctctccaaaagttaaaaagaaagaaagaaagaaagaaagtatttgccctcttctctttcctccaggaaactcttcataattctcttcaagggccttgggatttttacaaaacccaagaggaggctttgactctattgctggtaaattttgcctgggaaaaatccccagtcccaggaaagcaatggaagatgtactttctcccattgagagaaactggg

SEQ ID NO: 631 - DNA, 353 bp, Homo sapiens
  misc_feature (294)..(294): n is a, c, g or t.
  misc_feature (303)..(303): n is a, c, g or t.
cctgtttatttggcacttaaggtgattctgaaaatcctttaaacttaaagtagatggaatcttaagtatggggccttttagtgtccgtaaagaaaaactgcatgcaacaaaatatagcaggtcctcacttgttgagattcatggaaattgtgactttaaatgaaatgacatggctgggcatggtggctcacacctgtaatcagcactttgggaggccacggcgggtggatcacgaggtcaggagttcaagaccagcctgggccaacatgggtgaaaccccgactctactaaagntacaaaaanttaggccgagcatgggtgggtgcacgcctgttaatgggaggctgaggccg

SEQ ID NO: 632 - DNA, 399 bp, Homo sapiens
  misc_feature (10)..(10): n is a, c, g or t.
  misc_feature (14)..(14): n is a, c, g or t.
  misc_feature (80)..(80): n is a, c, g or t.
  misc_feature (156)..(156): n is a, c, g or t.
  misc_feature (160)..(160): n is a, c, g or t.
  misc_feature (162)..(162): n is a, c, g or t.
  misc_feature (361)..(361): n is a, c, g or t.
  misc_feature (380)..(380): n is a, c, g or t.
cgcccacggnccgnctgatgtgggccgactcgttcttgccgttgatgagctgcagcccgaggatgccgtctggggcgtangcaggggcgttccccgagatctcgcgctcgccgaccagccacacgtacccggagcccgtcatgttcagcatcgcgnctgncngttatacagtggcagcatcgtcctcgctggcagaaaggatgatgacccgggcctccagctctttcgcctccatcagcagggccgtcacgttcttggtccctgggtcaaactgcagcaccttctctgccttggactcacgctcctccagcagcgtctccaggcgtttctgagccgcccggccctcgtggtcgtcgctgancagcaggatgatgtggttncagctgtagaacacggatc

SEQ ID NO: 633 - DNA, 352 bp, Homo sapiens
tttttttttttttttttaatttttttttatttatttattttgagacagagtctcattctgtcccccaggctggagtgcagtggtacgatcttggctcactgcagcctccgcctcctggattcaagcgattctcctgcctcagcctgccgagtggctgggattacaggtgtgcaccaccatgcccggctaatcttttgtatttttagtagatatggggtttcaccatgttggccaggttggtctcaagctcctgacctcaaggatccgcccaccttggcttcccaaagtggctgggttacaggcgtgagccaccatgcccagccagaatgcaaccatatgtttaaagataata

SEQ ID NO: 634 - DNA, 368 bp, Homo sapiens
cacttagtcagtcaagcagtgtaatcttttttttttttttttgagacagagtcttgctctgtctcccaggctggagccgtacagtgttttggtgatgaagaggaaagtgttcaggatcttcaggacattgacattgcatcgtggttcttcttgaacatcccctctgtggctataatcctcggtgcctaagtgagccttcacttgtatggccaggttggggagagactggcataatctttctattagtcacttcctggcaggacattcatatccttgtacggttcttagaagaacttaatagctaaatgatactaataatagctactgatatatactttacaaaactcttaacatctgtcatccttttc

SEQ ID NO: 635 - DNA, 400 bp, Homo sapiens
ctctttgtaagtaactttatttttatttacaacagaattggtggctttattcctccatctttagggacacttggcattagcagctagatggaaagtccgcagtgaagtcaaactcattctgccccagccacagctccggaagctcattggctcggtccaaccccagttccaccaccagcgacatcagcacttcctcatccactgggtccgaatcgatgatagcagggctctgggcaccagcatgaaggagagagtgattctgcccctcccgcctgggccccaaagtcccagttttgcaggggtcctgcctccccgggttggcctggagtggcagcagcatcccctgatactggctattaagtttctgcagctgcatactagccagcaagtgaggggcggg

SEQ ID NO: 636 - DNA, 426 bp, Homo sapiens
agtagagatggggtttcaccatgttggccaggcgggtctcgaactcttgacctcaggtgatccgccctcctcagcctgtcaaagtgctgggattacaggcgtgagccaccgtgcccagcctcaatgattattttaacctttatagctgtacttctgctttccatctttaattcttatttaccatatactttactacttttttttttttttgagacagggtttcgctctattgcccaggctagagtgcaatggttcaatcacagctcagtgcagcctcaacctctctggcttaagcaatccttccacctcagcctctgagtagctgggactatggaagcctgcctgtatctttagtagagatggaattttgccatgttgcccaggctggtctcaagtgatctacttgccttggcctcccaaagtact

SEQ ID NO: 637 - DNA, 475 bp, Homo sapiens
tatgagatgggggtcttactatgttgcccaggatggatttgaaatcctgggcttaagggatcctcctgctcaggctctggactagctgggattacaggtgtgtgccaccacaccttgctttcccactaattctgttcctgctagtttcttcccttacaagtaaggtgggtcatatttacctgtgagaaactcagaaatactcacttttccaggacagctggggtgaagagaatatgtagtggccactgtactttgtaggaaagacctagggctgcccagccagatgcaggggcttcccggggagaagtttcccgagaaggcccttctcttgcctgagtagcatctttgtgctcctttccgtgatactcgattgtcaagtgcaacagagggagaaggttgtcatcatctagcaataccttgtgtgctgactgttgaaaggccacattcacatcatgctcagttactgcagtgggtg

SEQ ID NO: 638 - DNA, 2943 bp, Homo sapiens
accaggcaacaccattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttcttgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacaaaaaaaaaaaaaaaa

SEQ ID NO: 639 - DNA, 431 bp, Homo sapiens
  misc_feature (10)..(10): n is a, c, g or t.
  misc_feature (26)..(26): n is a, c, g or t.
  misc_feature (41)..(41): n is a, c, g or t.
  misc_feature (43)..(43): n is a, c, g or t.
  misc_feature (270)..(270): n is a, c, g or t.
  misc_feature (282)..(282): n is a, c, g or t.
  misc_feature (377)..(377): n is a, c, g or t.
  misc_feature (389)..(389): n is a, c, g or t.
  misc_feature (397)..(397): n is a, c, g or t.
  misc_feature (410)..(410): n is a, c, g or t.
  misc_feature (417)..(417): n is a, c, g or t.
cggagtcccntcgttgttgcccaggntggagtgcaatggcngntctttggctcaccacaacctccgcctcccgggttcaagagattctcgtctcaaacttccgagtagctgggattacaggcatgcaccaccacacccggctaattttgtatttttagtggagacagggtttctccatgttggtcaggctggtcttgaactcccgacctcaggtgatccgcctgcctcggcctcccaaagtgctggggattacaggcgtgcgacccacgncccagccacctnttaaatttcttaatcacggattgttttcagctcaggacatacacaagggcaagtaggaattactaataaaatcacttttaccctcaaccattcanggtctctaaggngcatgcanaggggttacatgncgggggnaagggaaggcactt

SEQ ID NO: 640 - DNA, 4034 bp, Homo sapiens
agggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaaaaaaaaaaaaaaaaaaaaaaaa

SEQ ID NO: 641 - DNA, 354 bp, Homo sapiens
  misc_feature (184)..(184): n is a, c, g or t.
  misc_feature (343)..(343): n is a, c, g or t.
  misc_feature (351)..(351): n is a, c, g or t.
gtaaaaggcaaaaatttgagacttataagctatatggtagcttatttttgggtggggaagaaatgagaaaagaatataacatctcttactggcatgacacattttgataaaaaatcttattgtcctttcctactaggaatgatccactgtaagggcaaaaataatatacaaggcaaagtttttntttgggaggacagagtctcactctgtcacccgggctgggagtgcagtgggtacgattcttgggctcactggcaacctctccctcccggggttcaaggtgattcttcgtgcctcagcctcttgagtagctgggggtttacagggcgcgtgccactgcgtnccggctanttt

SEQ ID NO: 642 - DNA, 375 bp, Homo sapiens
  misc_feature (304)..(304): n is a, c, g or t.
ttctttttaagagaaagatttggccgggtgtggtggttcacacctacaattccagcactttgggaagttgaggtgggaagattgcttgagcccaggagttcgagaccagcctgacaaaaagttaaaaagttagccaggtgtggtgttatgctcctgtagtcccagctactcaggaggctgaggtgggagcactgcttgagcctggaaggccaaagctgcagtgagctgtgatcatgctactgcactccagcctgggtgccagagaccctctttccaaaaaaaaaaaaacaagagagagagagangagatttaattctctggctttcttgtcacttccacagctagagggcttggcagagaataaatgataagacc

SEQ ID NO: 643 - DNA, 356 bp, Homo sapiens
gttttgtttgttttgtttttttttttaatattttttaagagctgtaaagaaggagaagaggaatgagaaaatgagaaagaattattattattattggtggtagtagtgatagagactgtatgtggcctataaaggctaacatattcactgtctgaccctttagagaaagtttgtcaacccctggcctagaacatgggtggcttcttactagggctcagtaagtgtctgaatgaaggaaggaacagtttaaaactcagctttgccgggcgcagtggctcacgcctgcaatcccagcaccctgggaggccgaggcgggcggatcatgaggtcaggagttcgagaccagcccggccaac

SEQ ID NO: 644 - DNA, 343 bp, Homo sapiens
ttttttttttttttttttggggtttaaaacaacatgaatttattattttatagttctggaggttggaagtcctacagtcaaggtgtcagcagggttttgttcctgctggagtctctaggggaggatccattttcttgccttttccagcttttagagaccacccacattccttggcccatggccctttccttccatcttcacatctgtctctcaccactgcgtccatcatcacagctcatctgtgactttgacactccagtctccctattataaggacccttgtgattatactgggcccattcatgtaattcagagtcacctccccagctcaaaatccttaatc

SEQ ID NO: 645 - DNA, 326 bp, Homo sapiens
cccaggctgaagttcatggcgcgatctcggctcgctgcaacctccacctcccgggttcaagcaattctcctgcctcagcctcctgtgtagctgggattataggcacgctccaccgcgcctggctaatttttgtatttttttagtagaggtgggatttcaccatgttagccagggtggtctcacacccttgacctcaagttgtctgcccgcctcagtctcccaaagtgctggggttacaagcatgagccaccatgcccagccacagtgtaaattttatttgtaattattggatttctggttcaagttgatgtttgaaaaataaaaaa

SEQ ID NO: 646 - DNA, 398 bp, Homo sapiens
  misc_feature (17)..(17): n is a, c, g or t.
  misc_feature (19)..(19): n is a, c, g or t.
  misc_feature (234)..(234): n is a, c, g or t.
  misc_feature (269)..(269): n is a, c, g or t.
  misc_feature (295)..(295): n is a, c, g or t.
  misc_feature (297)..(297): n is a, c, g or t.
  misc_feature (376)..(376): n is a, c, g or t.
ttttttttttttttttncntacagagtctcgctctgttggccggatctcagctcactgtcagctcggcctcctgggtttatgccattctcctgcctcagcctcccaagtagctgggactacaggcgcccaccaccacgcccggctaattttttgtatttttagtagagatggggttttaccgtgttagccaggatggtcttgatctcctggcctcgtgatccgcccgccttggnctcccaaagtgctgggattacaggcgtgacaaccngtccccggccgctgtcttgtactttnanacaactgaaagtgcagcacgtttacaccagcaccataaacacttaaataatgtgctgcactaatggtgttactaactgntactaaattgcgggtcgacgcg

SEQ ID NO: 647 - DNA, 447 bp, Homo sapiens
  misc_feature (354)..(354): n is a, c, g or t.
tgaaagttgaatattttattatttacacatataaagtgagaatgaaaattgggcatggggcaagggcaggaagatgactccagctcagtcggtgatgatgagctcgtccaccccccagtcttcatagctcccatctggcaggtaacggcgaatgatgatggggatctttcgggccttgagttccttcatggcaatgagcagaggatctgtctccccctccagctccaccatcacaggggcacacatcgcaatctggagcgctcgggtgcccagcacgcgggctcgctcgtacttggtcatgtatggtgtggtgattcgcttctggttggcctgcggtcgctccccagaggaggnagtctcgacattctcctggccttcctcttcggcattctccaagtcatctagcccttcatcctcctccacatcatcagagtcgtcgccatcaaa

SEQ ID NO: 648 - DNA, 510 bp, Homo sapiens
  misc_feature (270)..(270): n is a, c, g or t.
  misc_feature (361)..(361): n is a, c, g or t.
  misc_feature (376)..(376): n is a, c, g or t.
  misc_feature (492)..(492): n is a, c, g or t.
  misc_feature (500)..(500): n is a, c, g or t.
ttttgtagataatggggtcttaccatattgcccatgctggtgtcaaactcctgggctcaagcaatcctcccacctcagcgtcccgagtagctgggaccacaggcacccaccaccatgccacactaaaattttttttttgggggggagggtagagaaggggtcttaccatgttgcccaggctggtgtcaaactcctgggctcaagcgatcctcccacctcagcctcccgacatgtaaacggtggctacatttccgcacaatccccgcggtntccctcattctgttttacaactactcccacataaagtaacgtaggaaagacggagccccgttattcccttaggaagggtaggactgggagntttgcagggaagctntaggggattaaacattcagagggccaacttgaggattaaaacggaaacacccggggtgatttttaaggttaattcaagaggccccttttcacgtgggggtgattttttaaacttantcaggggnctttttttca

SEQ ID NO: 649 - DNA, 301 bp, Homo sapiens
cgacggggtgacggtggctcatcctataatcctagcactttgggaggctgaggtgggtgaatcagctgaggtcaggagttcgacaccagcctggccaatttcgggaaaccccgtctctactaaaaacacaaatattagccaggtgtggtggcgggcgctgctaatctcggctactcgggaggctgaggcaggagaatcgctttaacccaggaggcagaggttgcagtgagctgagattgccgcattgcaccccagcctgggcacacaagagcaaaactccgtctaaaaaaaaaaaaaaggt

SEQ ID NO: 650 - DNA, 449 bp, Homo sapiens
tagagatggggtttctccatgttggtcaggctggtctcaaactccatctctactaaaaatacaaaaaatagccgggtgtggtggcgggagcctgtagtcccagctactcgggaggctgaggcaggagaatggcgtgaacccaggaggcagagcttgcaggaaaccaagatagtgccactgcactccagtctgggagacagagtgggactccgtctcaaaaaaaaaaaaaaaaaaaaaaaaaaaaaaaaaaaaccctccttgttttaatatccaataagtggggcgtaaaaagaacatatagaaaaattggctgtgtgttaggaactaagctgttgctcaagaaatgatagatcttgttattatcaggacacataagaaagtaaatcaataatagaggaataaattagctagcctttaaaactgagggaatattttaatctcattttgtt

SEQ ID NO: 651 - DNA, 391 bp, Homo sapiens
tttttagtttttattatggttattattgtaagcatcagactcagtcgtgggatcacctcctccaggaagccttccctgattgccccaggttcaagctgtcttctgggcttccctagtgctgtccgtgacttctttggatcatgtctggcccaagatgggggttctgaaagaacatgccctcaggtgttggactcttccctctcttccagatgtacaggtggatcatctgaatctccttgccatcctcttcccttcagatatcaacagtgatggtgtcctggatgagcaggagctggaggcactcttcaccaaggaggtgagcatcttggaagcctcgggcacctggagggacgcccaaatcagccacttgtttcctcctgcagtcccctta

SEQ ID NO: 652 - DNA, 414 bp, Homo sapiens
tttttttttgagagagagtcttactctcttgcccaggctggcgtgcagtggcaaatctcagctcactgcaacctctgccttccgggttcaagcgattctcctgcctcagcctcccgagtagccgggaccacgagcgtgcaccatcacacctggctgttgtattcttagtagagatggggtttcaccatgttggccaggctagtctcgaactcctgacctcaagtgatccacctgccttggcctcccaaagttctgggattacagtcgtgagccaccacgcccggcctggaattttaaattctatcaacagattcacataggctttttccagtacattaaagaaaaagactctcatataacagaactaagttgcatgttacctttgaggagtgaggttaaatgaattaaagcatc

SEQ ID NO: 653 - DNA, 470 bp, Homo sapiens
tgagatacagtctcgctctgtcgtccaggccggagtgcagtggcgtgatctcggctcactgcaacctccatctcccgggttcaagcgattctcctgcctcagcctcccgagtagctgggactacaggcgcccgccaccacacctggctaatttttgtgtttttagtagagatggggtttcaccatattggtcaggctggtctggaactcccgacctcagttgatctgcccacctcggcctcccaaagtgctgggattacaggtgcccgccaccacgcctggctaatttttgaatttttagtagagatggggtttaaccatattgttcaggctggtctggaactcctgacctcaggtgatctgcctgcctcggcctcccaaagtgctgggattacaggtgtgagccaccacgcccggccgaaactgcctttttctattgtgaccaccccagtcctgtgctgtcagggatgg

SEQ ID NO: 654 - DNA, 479 bp, Homo sapiens
  misc_feature (216)..(216): n is a, c, g or t.
  misc_feature (224)..(224): n is a, c, g or t.
  misc_feature (295)..(295): n is a, c, g or t.
  misc_feature (353)..(353): n is a, c, g or t.
  misc_feature (367)..(367): n is a, c, g or t.
  misc_feature (375)..(375): n is a, c, g or t.
  misc_feature (396)..(396): n is a, c, g or t.
  misc_feature (421)..(421): n is a, c, g or t.
  misc_feature (426)..(426): n is a, c, g or t.
  misc_feature (448)..(448): n is a, c, g or t.
  misc_feature (469)..(469): n is a, c, g or t.
  misc_feature (475)..(475): n is a, c, g or t.
tttttttttgccaatctggaaaacttaaatataaattcagtattacatgttaaacttaaacttaagtttgttatatataataatagtgttgtatccgggagtggtggctcctgcctgtaatcccagcactttgggagggtgaggtgggtagatcacgaggtcaagagattgagagcatcctgggccaacagggtgcaaccccatctctactaaaantacaaaanttagctggggcgtgggtggtgcacacctgtaggtcccagctacttcagggagggctgagggcaggaaggantaggctttgaacccggggagggcagagggtttgcaggtgaggccgagatccatggccncttgcacttccagnctgggggnggaccaaaaccagactttccnttctttcaaaaattaaattaaattnaattnaatttaaaatttaaattaaatngtttttttgtggtttttaggnggaggntttt

SEQ ID NO: 655 - DNA, 924 bp, Homo sapiens
cagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggacttcaacaacctcaatggggaagaccaagacattctgatggaaaataaccttcgaaggccaaacctggaggcattcaacagggctgtcaagagtttacagaacgcatcagcaattgagagcattcttaaaaatctcctgccatgtctgcccctggccacggccgcacccacgcgacatccaatccatatcaaggacggtgactggaatgaattccggaggaaactgacgttctatctgaaaacccttgagaatgcgcaggctcaacagacgactttgagcctcgcgatcttttgagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaac

SEQ ID NO: 656 - DNA, 424 bp, Homo sapiens
gagatggagcctcacactgttgcccaggctggaaagactggcaggatcttggctcactgcaatctctgcctcctgggttcaagtgattcttctgcttcgacctcccgagtagctggaattacaggcttacaccaccatagctggctgatttttgtattttcagtagagacagggtgtcaccatgttggccaggctgatctcaaacttgacctcagatgatcctcctgcctcagcctcccaaagtgctgggactacaggtgtgagccaccatgcccggccttattgtcattattttgaatggaatgttttcttgttgtctaatttttcacagtgcttctgctgggaagataaaattaatatttttctacctactacttatctgccttactaaattctgttaattccataatatttctgagttttg

SEQ ID NO: 657 - DNA, 434 bp, Homo sapiens
gttttgtttttgagatggagtctcgctctgccacccaggttggagtagagtggtgcacgcaatctcggctcactgcaacctccgcctcccaggttcaagtgattcttctgcctcagcctcccgagtagctgggattacaggcgtgtagcaccacgcccagctaatttttgtatttttagtagagacggggtttcaccatgttggtcaggctggtctcgaactcctgacctcatgatctacccgctttggcctcccaaagtgctgggattataggtgtaagccacagcgcccagccagggcccatgtttttaaattttttaaggagcttgttgaggtctgcaaaagcttctgctaaacctttcactgtgaattttcttggaggttcttcctttttgtctcctgcagtttccttttctcttgcaccttcttcagct

SEQ ID NO: 658 - DNA, 472 bp, Homo sapiens
  misc_feature (459)..(459): n is a, c, g or t.
ttttttttttttccccaaaagtagctgacatttattgaatgtttgatttctcagtacaagacactttaccaaatgctttccatgtagtcttttgtataatccctaggaggtaggttccataaaaattcctattttacagatgaggaaattaatgttcagggaggtggaatagcttactctaagcccagagcgataggttttggatttgaaccccggcaatccgaccccccagaacttaacaatgtcatcctttgttgaatctctggcacagtgtccaccaatgtcttccgggggacccagtgtttattgagaatatttattgattgccattaagtaccaggcattacccccaatgctagttatattaactcatttaactctcgaaagcactctgtaaggcagatattattatcccactttatagaggaggaaactgtggctcagagttttcttaataantgcctgccaaaaa

SEQ ID NO: 659 - DNA, 1021 bp, Homo sapiens
aaatgaaaaaaaataatagttcactcaaacacaacttccgggttgaaggttcaacgattctcctcctcacctccaagtactgggactacagacatgcaccacacacccagctaattctgcatttttagtagagaaggggtctcaccatgttgcccaggatggtctggatctcctgaccttatggtccgctcgcctcggcctcccaaagtcctgggattacaggtgtgacccaccgcgcctggcccaaagtgctgggatgacaggcgtgagacaccatcctgccccacagaaaagatctgagatgggacagcccccgcagatcaggacgtgggctctgttatctggggggtgaccgactcaccctgcctcctctcgtctctgcaggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgatttttttttttttaacccactcactggtcccggtctctggattcagccccattcctccaacactactagagagactgtttccccggttttttttttggggagatggagtcacgatctgtctcccaggttggagtgcagtgatgcaatctcagctcactgcaaccgctgcctcccgggctcaagcaattctcctgcctcagcctcccaagtaggtgggattacaggcacctgccaccacccctggctaatttttatattagcggtctcgaactcctgaccttgtgatctgcccgcctctgcctcccaagtgctgggattacaggggtgagccaccacacctggccttttttctttaaa

SEQ ID NO: 660 - DNA, 522 bp, Homo sapiens
  misc_feature (436)..(436): n is a, c, g or t.
ttttttatataaattcatgtttatatatgacaattgaggagagttaaagaacaagataattctggatggaaaaatcagtttgcctgggcatctgtaaacctttgggcaagtgaattccctcttctctctcagttcaccctttggtgacctccaccgtggctgcagacttcaggtggtcctcacgcattcacagaactgtctgcttaggttacagcactttgggaggccgaggtgggtagatcacgaggtcaggagatcgagaccatattgaccaacatggtaaaaccccatctctactaaaatacaaaaattagccgggcgtggtggcgggtgcctgtagtcccagctacttgggaggctgaggcaggggaatcacttgaacctgggaggcggaggttgcagtgaactgagattgcgccactgcactccagcctgngtgacagagacttcctctcaaaataaaaataaaaataataaaataataaatggttcttttctatgcgtctaatgaatttaagtgct

SEQ ID NO: 661 - DNA, 355 bp, Homo sapiens
ggggaactgcagggaggcgcgggccgcatccctcccggaggtctgcgagcttcttgaggcctcacgcccccttttgagccccgctgctgccctgtggcgctgcttctccatccctgcgggtgaccatcgacgcgttccccttgctcgcttcttggttacgggccaggggatactcctgcccgaccctcggcattgcccaagggagtttgcacttcccactgtgctctgccaagcctctgtggagaggagccctccacctgcctgaccgggcccagctttggggaagaccttcttggttttgtctgctggctggactgaccctggccctcagcccaggtgaggcgaccagcggcat

SEQ ID NO: 662 - DNA, 252 bp, Homo sapiens
ctgtgcaggtaattttcctatctttatacatagatcttcctgacccctcctcctgaccccactctgtcactgaggctggagtgcagtggtgtgatcacagctcactgcagcctcaacctcctaggctcaagtgatcttcccacctcagcctctcaagtagttagggactgcggggcacatgccacaacgcctgggctaatttcttaatttttgtttttttttggagacaggggtctcactgtgttgcccagg

SEQ ID NO: 663 - DNA, 361 bp, Homo sapiens
tggttattaaagtccagtatatttgaagagatttccaaaaagtaagtattaaaagttgactggaaacattgctccttgcctctgctttgaggtgagacaagtgtaagaattttatggctaagtacaccatgcctttagattacctctacttaaaatggcaaagcagtatcaagaatccttagaaggaagtcttttaacagatttatgcaaagagatcaacaagaacagtttgctcatagtgctttgtactttaaaatgggaggatagctactcagtgccaaaaacctaaaacactggccaggcccagtggctcatgcctgtaatcccagcactatgggaggccgaggcgggaggatcactt

SEQ ID NO: 664 - DNA, 341 bp, Homo sapiens
ggaggagcagggcaccagcttccttactccccctggctggatgtccctgagctaagtcccaggcgacttccatcgcaggatgcagctctttccctcagccagccccgctttgtagggcagaagctcctcccaggctgagggctgagcttcctaggcaggtggccctgacccagcttgctggtgggtttcacactgatagcagcaaacccagaagaccagagatggctttgacaccaggcacccagcttttgaggcagggcacccctgagagacagtcccccttgtcttcaccccatcccagatccaagtcagtggttcagattttgcccagggagaggcag

SEQ ID NO: 665 - DNA, 198 bp, Homo sapiens
  misc_feature (1)..(3): n is a, c, g or t.
  misc_feature (6)..(6): n is a, c, g or t.
nnnaanctgatagaaggtcttgctctgtcacccaggctggagtgcagtggtgccagatcatggctcatgacagtctcaacctcccaggctgaagtgatcctcccaccttacctccccatccccccaatccccagtagctagctgggactacaggagtatgctactgtgtccagataattaaaaaaaatttttttcctt

SEQ ID NO: 666 - DNA, 1539 bp, Homo sapiens
gtgaagggagccgggatcagccaggggccagcatgagccggagggagggaagtctggaagacccccagactgattcctcagtctcacttcttccccacttggaggccaagatccgtcagacacacagccttgcgcacctcctcaccaaatacgctgagcagctgctccaggaatatgtgcagctccagggagaccccttcgggctgcccagcttctcgccgccgcggctgccggtggccggcctgagcgccccggctccgagccacgcggggctgccagtgcacgagcggctgcggctggacgcggcggcgctggccgcgctgcccccgctgctggacgcagtgtgtcgccgccaggccgagctgaacccgcgcgcgccgcgcctgctgcgccgcctggaggacgcggcgcgccaggcccgggccctgggcgccgccgtggaggccttgctggccgcgctgggcgccgccaaccgcgggccccgggccgagccccccgccgccaccgcctcagccgcctccgccaccggggtcttccccgccaaggtgctggggctccgcgtttgcggcctctaccgcgagtggctgagccgcaccgagggcgacctgggccagctgctgcccgggggctcggcctgagcgccgcggggcagctcgccccgcctcctcccgctgggttccgtctctccttccgcttctttgtctttctctgccgctgtcggtgtctgtctgtctgctcttagctgtctccattgcctcggccttctttgctttttgtgggggagaggggaggggacgggcagggtctctgtcgcccaggctggggtgcagtggcgcgatcccagcactgcagcctcaacctcctgggctcaagccatccttccgcctcagcttccccagcagctgggactacaggcacgcgccaccacagccggctaattttttatttaattttttgtagagacgaggtttcgccatgttgcccaggctggtcttgaactccggggctcaagcgatcctcccgcttcagcctccctaagtgctgggattgcaggcgtgagccactttcccagcctctctttgctttgcctgccccgttctcttaactcttggaccctcctcgtctgcatggtaactccgtctgagtctaccattttcttgctctccctccttccttgggcctgcctcagttccctttggcctccccctttacccagctcttggggtgtctctgttttttccatccccacttcctgccttctcgtggccctgtgtgagcacatgtgtacatctcagccttatctcaaggaggtgacaccttctctccttgtccccatctggccgtctctctgtgcttccctggccaggggcgtgcctgctggtcctatggggggaaggctactccgcatctcagccaccttcctcaggctcactccacctacatccccagtctgccacaccccatccctttgggcctcagccctgtccctttgatgtcctcctttccttcagcccctctgccctgtccctgcacacctcc

SEQ ID NO: 667 - DNA, 2103 bp, Homo sapiens
gggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacaaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagctttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgtt

SEQ ID NO: 668 - DNA, 1214 bp, Homo sapiens
gtctacaccccctcctcacacgcacttcacctgggtcgggattctcaggtcatgaacggtcccagccacctccgggcagggcgggtgaggacggggacggggcgtgtccaactggctgtgggctcttgaaacccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgagagacccagctgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccagtgaaaaaaaaaaaaaaa

SEQ ID NO: 669 - DNA, 392 bp, Homo sapiens
ttttttttttttttttttttttagtagagatgaggtttcaccatcttggtcaggctggtctcaaacttctgacctcaagtgatccaccgccttggcctcccaaagtgctgagattacaggtgtgccaccgtgcccggcctagtacatccacttcttaaaagccctcctcctggatgtgggcacagcattcctgctcatggtcccttggtgaaaaccagtcacaaggccgcagctagatgcaagggaagctgggaaatatagtcactgaccaagcagccacttctgtctccaccagggcttcccaacctcagcaatattggcattgcagggtggataattctttgttgtcaggctgtcctgtgcacatggtaggatgtttggtagcatccctg

SEQ ID NO: 670 - DNA, 465 bp, Homo sapiens
ttaaaatttaatttttatttcaataggcttttgggaacaggtggtgttggattatatgaataagttctttattggtggtatctgatattttggtgcacccatcacccgagcagtatacactgtaaaccaatgtgtagtcttttattcctcacccccaccccccgcctttcccctgagtccccaaagtccactgtatcattcttatgcctttgtgtcctcatagcgccgtcccacttatgagtgagaacataagctgtttggtgtttccattcctgagttacttcacttagaataatagtctccaattccatccaggttgcagtgagtgccattaatttcattccttgttaaggctgagtagtattccatggtatatataccacatttgctttatccacttgttgattgatgggcatttgggctggttccatatttttgcaattgcaaattgtgctgctatgaaca

SEQ ID NO: 671 - DNA, 387 bp, Homo sapiens
gtttttttttttttttttttttttttttttttttcgagacagagtctcgctctgtcacccaggctggggggaaggggggcaatctcggctcactgcggcctctgcctcccgggttcaggggattctcctgtctcagcctcccaagtagttgggattacagttgcctgccgccatgcctggctaatttttgtatttttaggggagaggggatttcaccatgttggccaggctggccttgaagtcctgacttcagataatctgcctgtctcagcttcccagagtgctgggattacaggcgtgagccactgtgcccagctgagatctgatggttttaaaaagaggagctcccctgcatgagatctcactttttgcctgctaccatttatg

SEQ ID NO: 672 - DNA, 421 bp, Homo sapiens
gctcaatgatttttattttagcaaattgtagtcatttccatacattattttttacagtaaacattgccggatacatttccatacgtttttaaagaatagaggaggaggaagaggagggaaaaaaaggaaaataaataaataaacgtgtggagcaatcaactccagaatcacaccaatatttctaggtctaatggccacacagcaaaatcagcctcagttatcccattgtcttcatatcttaagaccccgcgatcctggcctcctcgtaagctccccggacccgggcgtcctcggtctcccctcatctactcttctgtcgggcaggtccgcgaccttccgcctcccgggccgtctcccgccgcacccggccctggtacatccccactacccagtccgggcccgtcctcgctctgggcctacc

SEQ ID NO: 673 - DNA, 463 bp, Homo sapiens
  misc_feature (300)..(300): n is a, c, g or t.
atttatttatttatttttgagatggagtttagctctttcgcccaggctggagtgcagtggtgctatctcggctcaccgcaacctccgcctctcaggttcaagcaattctcctgcctcagcctcccaagtagctgggattacaggtgcccaccactacacctggctaatttttgtattttttagtagagacggggtttcaccatgttggccaggctggtctcaatctcttgacctcaggtgatccgcccgccttggcctcctaaagtgctgggattacagatgtgagccactgcgcctggnccattaaggaaatttttaggagaaaacatggaatggaagaatatttgtacattaagtaactgacagcttactatataaaatgccatcaacatgttcgggcagtgggggctcaatggggataaataggcagtgtacacatgagtaactcaaggccatcatcaca

SEQ ID NO: 674 - DNA, 209 bp, Homo sapiens
ttgtcttaagtttacctgaaaatcggcctaattttattaaatacatattctacccagggggagtggtttaaagaattatctgctttgtctgggcgcagtggctcacgcctgtaatcctagcactttgggaggccaaggtgggtggatcacctgaggctgggagttcaagaccagcctgaatcaacatagaaaaaccctatctctactta

SEQ ID NO: 675 - DNA, 563 bp, Homo sapiens
  misc_feature (12)..(12): n is a, c, g or t.
  misc_feature (17)..(17): n is a, c, g or t.
  misc_feature (27)..(27): n is a, c, g or t.
  misc_feature (443)..(443): n is a, c, g or t.
  misc_feature (462)..(462): n is a, c, g or t.
  misc_feature (484)..(484): n is a, c, g or t.
ggaccccgcagngatgngggctcctgnccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggcgactgaagtttgccaggaagcccctgtgcatgttggacatctttgtgctgattgcctctgtgccagtggttgctgtgggaaaccaaggcaatgttctggccacctccctgcganctggcgcttcctgcagatnctgcgcatgctgcgggatggancgggagaaggtggcacctggaagcttctggggctcagcatctgtgcccacagcaaagaactcatcacggcctggtacat

SEQ ID NO: 676 - DNA, 275 bp, Homo sapiens
  misc_feature (176)..(176): n is a, c, g or t.
  misc_feature (245)..(245): n is a, c, g or t.
tgtattttcagtagagacaaggtttcagtcttgaattcctaacctccggtgatccacctgcctcagcctcccaaagttctgggattacaggcatgagaaaccatgcccagccgatttctctcatttttttttttttttttttttaagagacaaggtgctcgctgtgttgcccaggnctggtctcaaactcctgggctcaagcaatcctcctgccttggcctcctgagtcaaaaagtgcatctcanatagttttaaaatggatgtgcaatatttag

SEQ ID NO: 677 - DNA, 406 bp, Homo sapiens
  misc_feature (365)..(365): n is a, c, g or t.
  misc_feature (380)..(380): n is a, c, g or t.
  misc_feature (397)..(397): n is a, c, g or t.
  misc_feature (402)..(402): n is a, c, g or t.
tttttttttttttttcacatttgagcagagtttattagcatttttgaattatcagagataatattagattacagtatcatatagtattagataagatgcaccgttgacacaggtacagaagtttccatatagttcaactgattttttatttattttttatttttttgagatagggtctgactctgtcacccaggctggagtgcagtggcccatctgagctcactgcaacctccaccttgcaggctcaaacgatcctcccacctcagcctcacaagtaggctgggactacagggcatctgacaccacacccagctaatttttgtatattttgcaggagacaggtttctcggccatgttgcccgggntgggttctccgactncctgaggcccaaggtanttctngccc

SEQ ID NO: 678 - DNA, 399 bp, Homo sapiens
aattttgagagatgttgctcaggctggtctcaaactccaggcctcaagtgatcctcccaccttagactcctaaagcaccgagattagaggcatgagccactctctacttctatgagatcttttttaccttccacataagtacagtacatggagtatttatctttctgtgcctggcttacttaacataatgtcttctaagatcatacatgttgctgagaataacagaattttgtttttttaatggccaaatagtattccacggggtatatataccacattttatctgttcatttgctgatagacacaggttgattccaatcttgggtactgtgaatagtgctggaacgagcatggcaggtgcagatgtctccatatatggattttcttttggatatatac

SEQ ID NO: 679 - DNA, 475 bp, Homo sapiens
  misc_feature (473)..(473): n is a, c, g or t.
gttagggtaatgtttattaaaaattcaaaagaaaacaaatgttatcaatgatggagagaaaaggaaccttgtacactgtcactgggaatgtaaattggtaaagccattatggaaaacagcatgattattcatcaaaaaattaaaaataaaactatcatatgattcaggaatcctacctatggttaaatatccaaagaacataaaatcacatattgaagagatatcttcactcctatgtttcttgaagcaatattcacaatagacaagatatgaaaacaatgtaaatgtccatcaacacataaatgaataaagaaaatgttataaagctaggcatgtggctcatgcctataatccctgtatttttggggaggctaaggcaggaggattgcttgaggccaggagttccaagaccagcctggggtaacatagccaggactctgttcctacaaatttagcttgggcatagtggtgcncc

SEQ ID NO: 680 - DNA, 330 bp, Homo sapiens
ttttgtgagaaagctctttactgggggtacagcgaggaggagcaaggccatctccccctacctgcccccaccccctcctagggtcctggggtgagggggggtcttccctccaccggaccaccactgtctttggtacaataaatagaaaaaaagggggagaggggcccaagggtccagtccttagtggggagggagcggccaaaaccctctccttgacccccctgccccaggccccaatcagtgcaggcctcacccaccccagctgggtagcagcaattccagtcaaggagagagatgaggatgggagcccagggcccccagatgggggag

SEQ ID NO: 681 - DNA, 424 bp, Homo sapiens
gtctagcatctaaaagatttttaggggttgtcaactctttaataatatatttataaaaagtagttgattccaaccacctccataaacaccatatattaggggataaattctagggagggatataaagtttaaaaagatactttccatctggacgcagtggctcatgactgtaatcccagcattttctttctatttttttcaaagagacaaggtcttgctatgctgcccaggctggcctcaagcaatcctcctgcttcagactcccaagtagctaggactgtgggtatatacctctcaccagcttatattgcctcttataatgagggactaactaatgttgccttggatggcagttaagactaaagagaaaagagcgtagaagatatatttgagacagaccactgaagaatcaccaggaattcac

SEQ ID NO: 682 - DNA, 189 bp, Homo sapiens
aatgatatctttcccttgtattgccttttcctgtccatgaacacaattgcttgcttcattcattccgtttctcatatcttttagtaaacttttataattttctccataaattcttggcatcagtttattgaaacctctcactagacaagaagttgacttgcggccatgctcctgcttctccattctttg

SEQ ID NO: 683 - DNA, 389 bp, Homo sapiens
caaaggaaaaagatttaatatattcgagtcacatcatgacaaatgatacaaacttgtgaaatatcatttcttcctctttttgtatttttttgtagacactttcgccacattgcccaggatggccttgaactcttgggctcaagtgacccaccttccttggccccctaaactgctgggattacaggtatgaggaactgagcacttttctattttaactaaccttgccatcttttcccgtgcttttctgttactgtcccctcctgttttcctactacattgacaggttatcttgacaggtgcagccctcccccaacagtatagaagtttattcttagacaagctagcacaatatacttttttttgagacggagtgtcgctctgtggctccg

SEQ ID NO: 684 - DNA, 478 bp, Homo sapiens
attttaatgtattttattacacctcataccaatcctttggtttacttttcatatactaagcagttggatttagagaaaatggtataatttaagtggaaaattatttgaaacattataataatgatctcttggctaaagagaaacaaatggtaaactcacagccagccaactcaactatacctctcattccaaagtagtaattttgaagcttgtacaaaacaaaaataccatgacaatggcaattttgctctaaatatattccaaaggaaacttaccatattggaaaaaagccacaaactgcaccaaaagcactcaaatagaggtgagcttggcttgattagggcttgtgttctccttagcaagatcagcacctttccctcagttacttcaacagcaagagtagatgctctgcacaggccgccctgccagtaaactcccagccaggaaatgttgcctttgcaccttgaatttatacagg

SEQ ID NO: 685 - DNA, 325 bp, Homo sapiens
  misc_feature (4)..(5): n is a, c, g or t.
  misc_feature (273)..(273): n is a, c, g or t.
  misc_feature (278)..(278): n is a, c, g or t.
  misc_feature (293)..(293): n is a, c, g or t.
  misc_feature (303)..(303): n is a, c, g or t.
  misc_feature (311)..(311): n is a, c, g or t.
cccnnctggtttcaaactcctgacctcagatgatccacccacctcagcctcccaaagtgctgggattacaggcgtgaggcaccacacccagcccagatgagcttcttttcttgtttattgccaaataagagtcctttgaattatacatcatgttgttttgagccattcacatgctgatgaacatttgagttgtttttcactttttgactattattgatgctgctgtgaacgttcacctgcgtgtgcttgtgtggggcattctgaggaccagancacgngtaagcaaaagtgangctacatttngttggganatgatgctggtatc

SEQ ID NO: 686 - DNA, 348 bp, Homo sapiens
  misc_feature (212)..(212): n is a, c, g or t.
  misc_feature (269)..(269): n is a, c, g or t.
ttttttttttttttttttttttttttttttaaagagatggagtcttgccatcttacgcaggatggtctcaaactcctgggctcaagcgagtctcctgccttggtgtttcaaagtgctgggattacaggtgtgagccactgtgcccagccaacttctcattttaaaagaatttcagatttaaaaaaattgcaaaaatactgcgagagaatccncatatacttttcacccagatccaccaaatgttaacatcttaaataaccatattatgntgatcaaaaccagaaatactattaactactctacagacttgactcaaaattcaccaactgtctgcctaattttagtcca

SEQ ID NO: 687 - DNA, 319 bp, Homo sapiens
ttttttaatgtgacccatttatttatttatttatttatgatggagtctcaaaaaaaaaaaaaagaaagaaaaacaattcttgtaatcccagcactttgggaggcatatcacttgaggtcaggagttggagacgagcctgaccaacatgaaaccctatctctaaaaaagaaaaagacctctttgcaaacaaccttggtgcaaaagtttactactaccatttcattctcaacattaaggacctagtgtgcttggtgggtggacaagaaaacaaatctaggaaagggaaagcttttctacacaaagagtagtagcacctcaa

SEQ ID NO: 688 - DNA, 1497 bp, Homo sapiens
cggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcccgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaagcatgcaataaataaaactcccttatttgaca

SEQ ID NO: 689 - DNA, 444 bp, Homo sapiens
ttttttttttttttttttttttttgagatggaattttgttcttgttgtccaggctggagtgcaatggggtgatctcggctcaccgaaacctccagcctgggtgacagagtgacaccctatctcaaaaaaaaaaaattcttcattgctcatatacgtcagattattacaattttggtatgcttaaaaatcacagagagccaaataaggtggccaagagagaagaaaatgataagttgtccacacaagcgctctgatccaagttaaaaacaagcaaagtaaggtatgggagtacaaaatcacaaaaatattttagagcattttaaaaagggggctattataattatcttcttttaattattaattttaatatcttaacatgccaccaaattaaattcttcctgaatagagaaagataagcttttaaaaattctgcatcattactgg

SEQ ID NO: 690 - DNA, 441 bp, Homo sapiens
tgagacagagtctcactctgacacccaggctggagtgtagtgcagtggtgcaatcttggctcactccaacctctgcctcctgggttcaagcaatcctcctgcctcagcctcccgagcagctggaactacaggcatgcaccaccacgcctggctacttttttgtattttagtagagatgggttttcgccatgttggccaggctggtcattaattcctggcctcaaatgatccacccacctcagcctcccaaagtgctaggattacaggcttgagccaccgtgaccagcccaaagattctgaaatagaattagggccaaccattcgctatagtaatagatactatgtcaaatgtggctgcatgctaggaagtgctacacaatcaacagggtaacttactagagctgcacactgcagaagaaatacaccttaataaaagcattg

SEQ ID NO: 691 - DNA, 388 bp, Homo sapiens
tagagatggattatgctctgtcactcaggctggaatgcaggggcacgatcacagcttactatagcctggaacctgggctcaaataattctcctttcttagcctgctgaaacagctaggactacaggcatgtgccaccacacccagctaatttttaagttttttgtagagatagggtctccctatattgcccaggctggtcttgaactcctgggctcaggcaatcttcccaccttggcctaacaaagagctgggaatactggtgtgagccactgcagctggcccattcctgcttttttcacttgagtctcatgacatgggtttgagagtcctcctcaccatctcttttttaacactatatttaagcaatctatttatgttagctcgcat

SEQ ID NO: 692 - DNA, 435 bp, Homo sapiens
  misc_feature (360)..(360): n is a, c, g or t.
  misc_feature (372)..(372): n is a, c, g or t.
  misc_feature (390)..(390): n is a, c, g or t.
  misc_feature (395)..(395): n is a, c, g or t.
  misc_feature (401)..(401): n is a, c, g or t.
  misc_feature (415)..(415): n is a, c, g or t.
  misc_feature (423)..(423): n is a, c, g or t.
tgttgttgaatattccttaatggagtcgatgaatttgcagagacccctccaagattcttttgtttgattcctttcatgaccatcaccctagaccttcaagtttgctgactagatttgggggttgtgtgtttagaaaggataacaagcttgtcatgggctagaacctgtggtcttcataaatagcttagtaggatatatggctttttctatgaaaggtggagaacatgcattaaaaatgggcaaattctggcctggggcatggtggcttatgcctgttaatcccagcacttggggaggctgaagcgggcaggtcgtctgagggtcagggagttttgagaccagcctggcccaaaataatgnaatcctgtctcntgctaaaactaccaaaantagcntgggcntggtagcacacccntagtcccngctacttgggga

SEQ ID NO: 693 - DNA, 500 bp, Homo sapiens
ctacttgggtttttggaacatcatcaatcatggattaggctcttgcttcttctctagctccagctcggcagccgtttgtactgctgcatcgactagcagcaggaagctgctgaagtcggcgtactcctctggagacacaagttctggagaagacggggaagtgatagaaatcttgacctttttctttggctgggctattccggtgagcttctggctaggggccgactccggatctggttgcttctctcttgacatctggccctttggcaagggcacaggggcaggctttgtacattgtctggaccactggccctgacttggccggcacagacgcctcggtgctctgcaggtgggtggcatgggcatctttgccccgttttgtggccaatgatggggtcgtttctacgctgttgaagcatatccgggagaatgcgtctgcgagcaatgataaacccgttagaaattcgccaccaagacaaaatgggcctcctctgcaacat

SEQ ID NO: 694 - DNA, 3023 bp, Homo sapiens
gattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtagaagaaacttcttcctgggagcctttcccacccccttccctgctgagcacgtggagttaggcaggttaggggactcggagactgcgatggtgccaggaaagggtggagcggattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaaaggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttacgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggatttgcttgaacccaagaggtccaaggctgcagtgagccatgttcacaccgctgcactcaagcttgggtgacagagcaagaccccgtccccaaaaaaattttttttttaataaacccaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttccaaaacattttttaatagaataaaatataatttgatcttaaaaaaaaaaaaaaaaaaaaaaaaaaaaaaaaaaaaaaaa

SEQ ID NO: 695 - DNA, 232 bp, Homo sapiens
tgagacggagtctcactctgttgcccaggctggagtgcagtggcgtgattttggctcactgcaacttctacctcccaggttcaagcgattctcttgcctcagcctcctgagtagctgagattacaggcatgtgccaccatgcccggataatttttgtatttttagtagagacggggtttcaccgtgttggtcaggctggtctcgaactcctgacctcgtgatccgcccgcct

SEQ ID NO: 696 - DNA, 446 bp, Homo sapiens
  misc_feature (386)..(386): n is a, c, g or t.
  misc_feature (435)..(435): n is a, c, g or t.
tttttttttgagacagagtttcactcttgttgcccaggctggagtgcagtggcgcaatcccggctcactgcaacctccacctcatgggttcaagagattctcctccctcagcctcctgagtagctggaattacaggcgcccaccaccacagctggctaattttttgtgtttttagtagagacagggtttcatcatgttggccaggctggtgatcttacctcaggtgatccacccgcctcggcctcccaaagtgcagggattacaagcatgagccacaatgcccggccaccttctattatttttaagttacccagtctgtgggtattttgttacaggcaggcacaaacaggactaagataacaaccaagaggccttacaggaaaganttgttattaattaaaaatactgggttaaggcacaaagtgccaggggtantgtttaggaaa

SEQ ID NO: 697 - DNA, 2287 bp, Homo sapiens
cgcgccccgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctcaaaaaaaaaaaaaaaaa

SEQ ID NO: 698 - DNA, 257 bp, Homo sapiens
tttttttttttttttttgaagacagagctccacttttgtttcccgggctgcagtgcagggtggcgatctcggctcactgcaacctccacctcccaagttcaagtgatcctcccgcctcagcctcctgagtagctggaatcacaggcgcctgccactgcacgcggccaacttttgcatttttagtagagacggggcggtctcaccatgttggccaggctggtcttgaactcctgacctcaggtcatccgcccgcctca

SEQ ID NO: 699 - DNA, 435 bp, Homo sapiens
ggcatgagccactgcgcctggcctaaaaaattgtattttataaatatatgtgcttagcaaaaagtgtggaaagatagataccacagttctgcacagtggataacaagtgacttattactatttttatttcttttctgtatctaaggaattttctataatgagaaattaatcatgagtcttttttagttcaaaatacagagccatttagaaagttaagtgctttaagtgtgatgcaagctgcatcataagttcaagggaatttagagctttttttttttttttcttcatcagagatacagcttcaacaaccaccaaaaaatggagctgttcatcatagcatcagatacttcaacacatttctggaaatcagaagccacctgtctggcacaaatctgaaaaggaagatggggtacgggtgtcctttttgcctgcaca

SEQ ID NO: 700 - DNA, 286 bp, Homo sapiens
cagatggagcctcgctctgtcacccaggctggagtgcagtggcacaatctcgggtcactgcaacctccgccccccagcttcaagcgattctcctgtctcagcctcccgagtagctaggattacaggtgcacgccaccaggcctggctaatttttatatttttagtagagatgggattttgccttgttggccaggctggtctcaaactcctgaccttcaggtgacccatccaccttggcctccccaaagtgctgggactacaaggtgtgagccaccatgccctggtc

SEQ ID NO: 701 - DNA, 429 bp, Homo sapiens
  misc_feature (283)..(283): n is a, c, g or t.
  misc_feature (384)..(384): n is a, c, g or t.
  misc_feature (402)..(402): n is a, c, g or t.
cgacgtttgttttaatggttcaaaaaaaatctttcttataaagagcataggtagaattagtgaactctttggatcctttgtacagataaaggttatagatttcttgtgttgaatattaaaaaagcaaggatgtctaaccattaagattatccaaagtcaggctgggcgcagtggctcacgcctgtaatcccagcactttgggagggataggtgggcggatcacctgaggtcaggagtttgagaccagcctggccaacatggcaaaaccccgtctctacaaaantacaaaagaaattagccagacatgatggcgggtgcctctaatcccagctactgggggaggctgaggtgggagaatcccttgaactcgggaggtggagtttntagtgaggcgagattgtnccattgccctccaacctggggcgacag

SEQ ID NO: 702 - DNA, 445 bp, Homo sapiens
tttgagtcaggttcttgctttgttgaccaggcgggagtagagtggcatggtcatagctccctgcagcctcgagcaatcctcctgcctcagcctcccaagtagctgggacgacaggcatgtgccatcatgccctcattaaatttttttttgtagagacagaatcttgctatgttgcccaggctggtcttgaattcctggcctcaagcaatctttctgcttcagcctcccgaagtgttgagattacatgtgtgagccgctgcccttggcatggagcattttttaaaaagcaggatcctgcaatgatattctctgcctctcatttatctggcctcagagcgatggcagagggagaggcagggctcttgtgcggggaggtcctgtgtcttctcactgctgagccttgttgaagaaatagatggaggtcaggatggtgaacaaggccatg

SEQ ID NO: 703 - DNA, 16459 bp, Homo sapiens
gtgcaatggtgcaatctcagctcgctgtaacctccgcctcctgggttcaagcaattctcctgcctcagcctcctgagtagctgggattacaggtgcctgccaccatgcctggctaattttttgtatttttagtagacacagggtttcagcttgttggccaggctggtctcgaacccctgatctcaggtgatccacctgcctcggccacccaaagtgctgggattacaggcatgagccaccgtgcccggatgaaaagtgcttttaaaaaagcataccccgtctctactaaaaatacaaaaaaaaaaattagccagacatggtggcaggcgcctgtagtcccagctactcgggaggctgaggcaggataatgacgtgaacccgggaggtggagcttgcagtgagccgagattgcgccactgcactccagcctgggcgacagagcgagactctgtctcaaaaaataaataaataaataaaataaaaataaataaaaaagcataaaataattcaatttttttgaaggacttttagaaactgtttaattttagaaactatctgattgtgatacatgctaacacactcatatactccctcctccccacaacacacacacagcctctctttgtcgctcataaagtcttcggaagctttctcagtgcttttaggagtatgacagaagtccttacatggccaacaggaacctgcatggtcttttcaccacttactgtgtcttcctcatctttctgttgtgctcccccttgtgctctcctccagccctgctgtcattcctccacatggaagtctttttttttttttttttttttttgagacagagtctcgctctgtcgccaggctggagtgcagtggcgcaatctcggcttactgcaacctccgcctcctgggttcaagcgattctcctgcctcagcccccccaagtagctgggactataggagcacaccaccacgtccagctaatttttgtatttttagtagagacagggtttcaccatgttggccagatctgctgacctggtcgtgatctcctgaccttgtgatccacccacgttggtctcccaaagtgctgggattacaggtgtgagccaccgcacccggccaggaagtcttttttgactcctgccatgttctcctggcacttcttccttatacagagatcacacatgcacattgtacatttgctcagtgagtgtagggactgctgctctggttttcttgtttgtttgttgcttatttctgtatcaccaggatctaacacaatgcttggttagctgtacccgagtatttactgagtgcatgaattccatccattgtattttctgtagctacctgatctttatttgaacctttcaagatatctcattccattttggtgttcttattataatagaaattagagaaaatatttgcaaccaaaatgagaaaaaggtaatattaatatacaaaaagctcatataagttactgaagaaaatgtctaaagccctaataaataggcaaagaatgtaaatagctaagtcacaaaagaaatcttagaatgcttaaaagatccaggtgcaatggttcatgcctgtaatcccaacactttaggaggccaaggcagtaggatcacttgaagccaggagttacaagcttagcaacaaagcaagacctcatctctacaaaaaacaaaaaaataaaaaaactagccaggcgtagtggcactcacctgtagtcccagctattctagagccaagggagggaggattgccttgagcccagggatttgacgctatggtgagctatgatcgtgtcactgcactcagcctgggcaataaagagacacactgactcttaaaaaaaatggccaaaagagatctgagaataattatctttactaggcatcaaataagtgcaaatcaaagcaaactgccacctattaattgagcaaaacatttaattgataatctatttttcagaatgtattggtctagttagaatatcaattcttacctttctgacagatgactagtcctttgtaaatacccagtcacctcttttcagttaaagttgctgtctccaaggagtttgcaatctaattggggaggtaaaatctcaactcaagaaatgagaagtcagcatgaaaacccattgatgtcgtattgcttttgctgctctgatgtggtggctcacacctgtaatcccagcactttgggaggctggggtgagaggatcacttgaacccaggagttcaagagcagcctgggtaacatggccaaaccctgtgtcaaaaaaagtttttaaaaattagcccggcgtggtggcacatgcctgtagtcccagctactcaggaggctgaggtgagaggatggctggaggctggcaagtagaggctgtaatgaactgagatggtgccaccagaaggacggagtttcccttaaccaagataatatgtatagtggctagtctggcacatggcacttactgggtattccataaagagtagtttatttccccaaaatgtagagtaagagtgaaagactttgatccaatgtacttctgtccacctacacaagcaaatagaatgtttcaccagaataattagacaaaaaattttatatgtaattggcacattggaatccttgtaaattactccttctgttggccaagagatttactcctttggtggaacttgtgtttttccatatgacaataatatagtaatggcaagtatatcaataataataaaactttttttaaaaagtaaagggaaaatcttaccaaattaatgtttcattttaaggaaaatatgactctatgcccatttttttccttccaggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctgggttagtttattctgtttaattatcatttttctgtacaaacagccaaacaaatactgtatgctcccaatagaagtcagcagtgtgttagaggaaatattagtgttttttatctattgcttcatttcttgttagaacaaaatgacacatagcccttcgtaaagtcttgtaaatggtgaatgttgaattctactttatctaaatcaaattttggagccccgcagtaaagttacaatctatgaatttaagtatttaaagataacatactgaagcctttgttcaagtgcatcagcttctctaattatgtgaatatatgaacttaagtgagtttttaatgagttggtagattgtgatttctccaaactaaaaaatgcaatgtttggaattatggctatggtgttagaaaagcactaatatataggaaataaaagaacttcacagtgtgagggggaaatggtctgcaagtatttttggctaaagacttcagagtcagacacattttatcgagaacttgtaatatgcaaatcagtttccaaattttgatcttaaggccttgtctccagggaatctctattacttacttctaattgaaatcagtgacttaaatgtttgaaactgcagtgcttaactcttaaacatgaaattgtagtcagtctttggtcaaaactaactaaaatgttcccaacccctagcatgatctagcaaagccatggtctcttctaagtactgtgaacatgagtctactcacagccccaccgaaacacagctcccaggacgtttgaatatctaaggcccagttatttaatgtctttgaaggcagctctctcagcccagcccctgtgaagaccacccacactccccttggctgatccacatgttctctcatacggttttggcagctctgtgttctcctcacaattaaaaaggaaacagaggtatggtttgggtctcactctacacgcttggaggctgaaaaccttttttgcttctgttcttttctcttgttcagggatgacctggaccgagccattgaggaatttacactgtcctgtgctggctactgtgtagcttcttatgtccttgggattggtgacagacatagtgacaacatcatggtcaaaaaaactggccaggtgagctgctcctcaggatctgccaagggccttagtaatgctatttcttatgtatagcataatctcttgtgcaactcagccagattcttttgtgattcttagtgtcatatctttgtctttacttcaatttctcactacctctcgtttcatatatagtctactacatgtattcatttgtttgcttgcttgatggtaagcatttatttgtttaaaaaattactaaaggctgtgtgtggtggctcacgcctgtaatcccagcactttgggatcccgagccggccggattacctgaggtcaggagtttgagaccagcctggtcaacatggcgaaaccccgtctctactaaaaatataaaaattagccaggcatggtggcaggcgcctgtaatcccagctacttgggagactgaggcaggagaatcacttgaacctgggaggcggaggttgcagtgagccgagatcgcctcactgtgctccagcctgggcaacaagagtgaaactccatctcaaaaaaaaattattgaaaaaatttttgtagttaaagtggcctgttcttcaatataagaaatagtatttgggatacatttgtacctaacagaaggagcggataatgtactggatgtattaaatttaaagattaccaatgctattcatatcctttgcccactttttgatggggttgtttgtttttttcttgtaaatttgtttgagttcattgtagattctggacattagccatttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaagttttcttctagggtttttatggttttaggtctaacgtttaagtctttaatccaaaagaagacatttatgcagccaacagacacatgaaaaaatgctcatcatcactggccatcagagaaatgcaaatcaaaaccacagtgggataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatataccatggaatactatgcagccataaaaaaggatgagttcatgtcctttgtagggacatggatgaaattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaaggacgagttaatgggtacagcacaccagcatggcacatgtatacatatgtaactaaccggcacattgtgcacatgtaccctaaaacttaaaataaaaaaaaaaaaaaagattaccaatgctaaaaaaaaaaagttgggatgaaccccacttgagttattttctcttttagaacatcatacctaattatatatgggagaagggagaacagtcgtgtgagtaatagcattctggggtacctagggaatctagaccatgttgtttataaagtacttaagttttcaaatgaaaatttcatttttcagagtgacatatttgtaaacactttttatgttaagcaaaaacagatgagatatcttagataatttttcagtttagcccccctaggaattcccacattagaggcatactagaatgaaaatctctctgggtcactgtgtgaactttggttctatgagggacccacagttttgtatctccttggaaatctggattagttctggcttgggctttgagagttgatgtggaatgaatttgtaatgcactataatacatgaatgcaccatgtacgattgaggaatctcgtgtccatacttaaaaggagtcccttggacttccgtccaatcacattaaacacttagatttatctccattttcttcttttacacctctaaaacaataataaggaattaagaaatatataaactcaagaagtcaaagatgataggaaaataggccacagtgggtgaaacctattaccagacttcggggtgatagaaagtgagatagagaagtggcagtgacttagcagaactgagaaaatagaaagtcagtacttgtaaaggggtacgcaagtcccataaaagctctggaatcagaggcaccatgtatactgttcaaggagggatacagaaagaggctgaaacagaactagttggcagcttatatatggaaccagttaggcactcaagtccccttcccttatgccaagaaggagacagatttattctctgaagaaactggttctgactcaagcacacttatttctacagagactacaagaaagggtcccatattaaaaatggagatggagtgaaagtcggcgtagtaaatggtacaatctgcagccacttccacttgctttattctaagaacagtggcagccagatgtatagttgaccctcatcaaaagactaggtgattctattctagaaatctgattggttccattgaaaagtcctgcagatctgacagttgagatttctccctagtttctatacaaggaagtccaccaatcaacaagcaagcctaccatgtacatagaattttcattcagctttttagtgattcattgttaaatatgaatggtcagctaaggattaatatacttttaaaaaatgacaaaaattgaatatgtttatcatgtacgacatattgttttgaagtatgtcttcattgtggacttgataaattgagctgacctgtgtgttacctcacatacttatctttttttgtgatgataacatttaaaacctagtctttcagcagttttcaggaatacaatatattgttgttaactatagttgccatgttgtaagacagatctgttgaacttattcctcctaagtgaaattttgtattatttgaccagtatctccccagcacctgcagccaccattctactctctactggattagcagacatttaagggaaacctctaccatgaaagatagaaaccaaataggcaaaatagggaagaaaagaaaagaactctgggaaaacagggtaactgcagtaaacagagggtgattttaaaaatcaaagcaaaaaaatatattgtatctttaaagtaataataggattctgttttttacaatcagcacatagaggtcttgaaaattagaaataggaacaaacaaaaagttaaaatagaaatagtgtaaatattttgtggcaggcatagttgtaagtgctttatatataatctaatgccttcaggcctgatgacaaccttatagagtggcggcaatagccccattttacaagtgaggatattaaggcaacagagagtagacatatcaggattttaaccctgggagtttggctcatattctttttttttaatccaccatgccttaatatctccaaaaaatatgataaatagagagaagatccagaaacaatagagactcagtccagggaggtatactctcagcctaatggatattccagaaagaaggagaatggcgtgaacctgggaggtggagcttgcagtaagctgaaatcacgccactgcactctagcctgggcgacagagcgagactccgtctcaaaaaaaaaaaaaaaaaaaaaaaagaagaggaaagaagggcacttactaagcaaataatatactaagacatttcccagagccaatgttcatgaatatccagtcaaaatagcacaaaaattttctgagaacggaagaaaaacacccttactaagtacctgcactatgaaatttcagtgcatcagacgtaaagagaaagtcttaaaactttcacagagacacagcaggccacataccagagtttagaagtcaaaatgacttggctcctcaatagctacattggcaattataagacagtgcacgttagccttcataattttgagggaaaatgatttctaacctaaaattcgataaccaaacttttttttttttttctgagacggagacttgctctgtcgcccaggctggagtgcagtggcgtgatcccggctcactgcagcctccgcctcctgggttcaagtgattctcctgcctcagcctccccaggcagctgggggaccacaggcatgcgccaccacgcccagtcaagtataaagggtagaatgaagacatttttccaacttgcagggtcacaaaacttgtcactcctctgcatcttttctcagaggctgccagaataaggacatctaccaaaacaagtgcctaaaccaataattatcaagtggggtgatttttcactcaggggacatttgttaatatatgaaaacagttttagttgtcataactggggggtggggtagtccagtggatagaggccagggatgctgctaaacacccatacaggacagaaccccatatcaaagaattatatggcctatgtcagtgtgtgccagtattgagaaaccctggtctcaaccaaaagagaatgtgatgtggacacaaaacgggctccaaatgggagaagaggaaagggaaggcccaggatgatggctctgcagcaacaccggagaacaaccagcccagctagaaaccagtagattacctgactgtctggaaaacagttttgaaaatgatttgtagatttgttgttgtttgatttgtagatttttaaggagagtttgggaagaattaatgctaaggtcatagaacactaagctaaatgaatgaatgaatacatgcgtacagttttctaaaggaaaaaaaggtgaacatgtgaaaaataaaaacactgaatattgatgtaaccagaaattatgacataatgtgccacagtgtgtagcattatgttagcataaaagtactaaatctttatcttccataataagaatagtaatatacaattagggagcaaaaataaatataaacatattatttagaaaaatggaggcagacaccaggaaaaacacctagtgagaagagtaagaagttacctctaaagagtagcactcaatgtggggagctagtagggcaaggatgtacttttttgtggttgttgttgttgttgagacagggtcttactctgtcacccaggcaagagcgtagtggcatcatcatggcccattgcagcctcgacctcctaggctcaagcaattcccccacctcaccccccctgagtagctgggaccacaggtgtgtgccactatgcctgactaattttttccttcatttgtagagatggggtctcgctatgttgcctaggctggccttgaactcctggtttcaagtgatcctcctgcctcagcttcccaaagtgctgggattgcagacatgagccaccacaaccaacctgtactcttttcttgttatgttttatagaactatttgactttttaaaaatcagacattttaattctttggatgtatttttctttctaaagcgtctccttttccactagatatctacagtttaatatcagggttatttattattgattgtaaaagtcttaagagtgttagatatggtctcttctcacctggctcagtgggctataaacagagggagaagggctcagatgtggatgggtatagttcctgggggtctaggactatggaggttttgcctttatatttggaacccaccagaaaaatgaaggaaattaaatcccatttgttttccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggtgagtactgcccttgtgccaaggctgaacacttctaacattttcttatctgaccaggtggaccagcatttcttagctgagatatatttggatctgggagatattcagtctgattataggaagcttttgggggaatttgcctgtcagattattgtgctggttcagaaattcccagataggagaaacagaatgctagaaatttaaaatagttattatattttattccaataatatactaccttttacctgtttcagaacattctctgaaactattaagacagttgataggaagatgctgaaaagacatctgctgtcattgtgtatggagtacagtaagggaactagaattcagggcaaattttttaatctctgatctattactggctacctacatgttcccaagcataatacttgtctttttgcctttgtatcatcttaaaatggggacaaaaatatgaaattaagggctactatgatggttagagacatatcatgtaaccaacacatacttaacaaatcattgtcactatcctttatagttctgtttgggtttctgcagaatatacctcagtgggtctagttttctctttggcaaaataaggggatacgattggatggtcctcagcctggcgcggtaggtcatgcctgtaatctcagcactttgggaggccaaggcacacagatcactggaggtcggagtttgagaccagcctgaccaacatggtgaaaccccgtctctactaaaaatacaaaaagtagccaggtgtggtggcacacgcctgtaatctcagctactcaggaggctgaggcagaattgcttgaacctggaaggcagaagttgcagtgagccaagatcacgccactgcactccagcctgggagacagagcaaggttccatctcaaaaaaaaaacattggatgatcttcttgagggaccatcttgaagaggagagagagggaaggcaggatgacaggaaggagcaaaagcactgacactgattgaggggacttttaaaaaattagtttctggaatcagaccacaaatatagaacccagaagtatgttcagaaatccttgtggattataattataactgatttaataatcagttcttgtgtctcatagaattaaaaagtctagattattattaaaaatgtaatagcctttcgtcatagaatttctatttagttttgtttttgaaaaatatatctgtgatgttagagagattgattgttttatgtagattttagtcctgggacaattttcgcagaagtaaaaatcagaaatgaacctttagttcagtaggaattttcttattctaatagaaagtctagctgtgttttcttaatttcctgtatgaaatgtgctctctcccctctaacactgtgctcatgtggtttgctgcatcacccaaaggttccgccagtgttgtgaggatgcatatctgattttacgacggcatgggaatctcttcatcactctctttgcgctgatgttgactgcagggcttcctgaactcacatcagtcaaagatatacagtatcttaaggtataaaaccacttttccttctctcttggactttgtgggcattgagctcagttttagctgcctgttttattcaagtggctgaaggaagtagaacaaagtcatttcctctaagatggttcttagccaggagggaaagaatctgggaagtacataaaggaggaattttgtagagtagcttgtaacccagaagattttcccatcagtagaaggggcgtaaagaagactggtattgggctgtagccttcttactcacattactgaaagaccgcagatcaggagcgggttgccaccttgattttccacagtctgcctttttcttgccaggatcttagtaggtcttgagtcatcttactggatttgggtggtagtggcaagcagctgtgcatcctgcagtaattataaattattttcatcttcaaaaaccttttggaagaagtcatattatctccctatcttggggttctgcctcctgcagatgatatttaaataagaacatgaagcatgctgcctgatggtggctggggaggcacaaccaatccagcctcctgcagactttgatatttgcacatctctactaaagttatataaaatcatattttcccccttccattttaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttggaatgggtgagcctcttctttatgggtagactgggcctttggaacttggcactggaactccaagaaatggccaagtcagtagacaaaccaacctcaggaataggctaaggcttattatggcctcttccctgacttctccccttgtttcccagcctcatcaggcatggtataggaggccccctggactttggtgggagcctgaggtaaggagccatgcatatgggaggtgtcctgaagtctgggtagttacttggcactgagccaaggccagactctgctgctttggagctcttgttcatggggcagatgctggagcagtccagttccttggaaataactcagctgaggatgggagttggcccctgaattcctcatttccagggctggtgtagactcactgagacttccaggaatagaactatggaaggacaggtttgttcagagatctttgtctagtagccacccaccatttcatgaaccaggccgcaggtcagtggtttggagaatggtgaacactgccaggaagaaatggataccattctttccagaggggtctcctcagccaaaaggagggccttgataaatacatgccaaatcagtgaagttcaagtcaactgtttttcccatatgggcaccaaattgtatctttcctgttttctttgaagggttaagtaacgtgaccatagtcacagagtagttgatggagccagtattcaaacccagaaagtaagaagcctattttaattatctgtgctctttactcacaatgcctcagtatacatttcagatttattgggttccacaaatagaaacctatggaaattttgaatcaaattgcattaagctatagacaaggttgagacaaattgacatctccagaatattgagttttccaaaatatgtaagtggagtacccatttatttagattatctttcatttatatccgcaatgatttatagtattctgtgtttacatattatgcatcgtttgttagattcctgggtaagtgactttattgtaagtttcattgttgttaatctatagcaatcattctccaagtgtggtcccctgatgaggagcatcagcatcaccagagagaactggttaaaaatgcaaattcttaatttttaatttttgtgagtacatagtagatatatatatgggatacatggaatattttgatacaggcatataacatgtaattatcgcatcagggtaattggggtatccattacctcaagcatttatcctttgtattagaaacaatccagttatactcttttagttattttaagatctataattaaattatcgactatagttactctgttgtgctatcaaatactagatcttattcattcttactattttttttgtacccatagaaatgcagattcttggtggggcctggcagctcacacctgtaatcccagcattttgggagggcgaggccggggaatcacctgaggtcaggagttcaagattagcctggccaacatggtgaaacctgtatctactaaaaacacaaaaattagctgggcatggtggctggctcctgtaatcccagctactcgaaaggctgaggtaggagaatcacttgaacccaggaggcggaggttgcagtagccgagatcacaccactgcactccagcctgggtaacagagtgagactccatctcaaaaaaagaaaaaaaaaagaaatgcacatccttgagccctgccctggagctactgatttagaaatgggggtggagccccaaacctgtatttaatttaatttatttatttatttattttttgagatggagtctcgctttgttgcccaggctggagtgcagtggtgtgatctcgattcacttcaacctccacctcccaggttcaagcaattatgtctcaacctcccgagtttagctgggactacaggtatgcaccaccatgtccagctaatttttgtatttttaataaagacagggtttcaccatattggtcaggctggtctcgaactcctgacctcaggtgatccacctacctcaacctcccaaagtgctgggattataggcatgagccaccgcacccagccaaacctgtattttcataaagttccagagcaaaggtccacaaatacatttgatgtttgtatttagcagacttataaactttctaattaatcctaacaatttatttgtatgaatttttttttttttttcttgagacagggtctcactatgtcacccaggctggagtgcagtggcgtactctcggctcactgcaacctctgtctcctgggcttaggtggtcctccgacctcagcctcctgaatagctggggccacaggcatgcaccaccacacgcagctaatttttgtttgtttgtttgtttgttttaagagacggaggtttaccatgttgcccaggttggcctcaaacttctggactcaagcagtctg

SEQ ID NO: 704 - DNA, 502 bp, Homo sapiens
tgagacagagttttgctcttgttgcccaggctggagtgcaatggcgctatctcacctcactgcaacctctgcctcccgggttcaagcaattctcctgcctcggcctcccaagtagctgggattacaggcatgcaccaccatgcccagctaattttgtattcttagtagagacagggtttctccatattggtcaggcttggtctcaaactcccgatctcaggtgatctgcccgcctcagcctcccaaagtgctgggattacaggcaagagccaccgcgcccagcacggtcttttcaaagaccagataatttatttaaccaactgtctaaagatggacattgtgattgatcacactattttatatgtaacattgaatggagtgggtgagtctaggaaacatctctcctaaaagtttacattttcatgactagaagtgaccaaatagatctactgatgagaaaagacttttgaaagcagtatggtcagttggcagtgaatggctc

SEQ ID NO: 705 - DNA, 148 bp, Homo sapiens
ttgttttgtagagatgtggtctcgctatgttacaggctggtctcaaactcctgggctcaagcaatctgcctgcctcagcctcccaaagtgctgggatcataggcatgagactttgtgccaggccttctatttatgttcttggtcgacg

SEQ ID NO: 706 - DNA, 295 bp, Homo sapiens
agctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaacctgtctctactaaaaatacaaaaattagccaggcatggtagcaggtgcctgtaatcccagctactggggaaagctgagggcaggagaattgcttcaatctggaaggcagaggttgcagtgatattgcaccattgcattc

SEQ ID NO: 707 - DNA, 445 bp, Homo sapiens
ttttttttttgagacaaggtctcactctgttacccgggccggaatggagtggctcaatcatagctcactgaagcttcaaattcctgggctcaaacgatactcctgcctcagcctcccaagtagctgggaccacaggcatgagccaccatgcgtggccaatttatgtatttatttatttttaagaaatggggtttcaccatgctgcccaggctgatcctgaactcctggcctcaagcaatcctcccgcctcagcctcccaaagtgttgggatgacagatgtgagccaccacactcacaattctttttttttaaattatttcttgtatctgtccctttcttttccacccccattgctacttcttcagttgagacctcacaaatgtcacctggatcactgtaaaacattaaacttgatcacttgatcactagttcccactttagaata

SEQ ID NO: 708 - DNA, 436 bp, Homo sapiens
gagataaggtctcactctgtcatccaggcttcagtgcggcagtgtgatcatagttctgtaacttaaactcctggcctcaagcaatcctcctgcctcagcctcccaaagcgctggtattacagatgtgagccaccaagcccagcctaaacagcatttctctattaaaccttttcagaagactgcatgattagccaaaagtgacttttttttttttttgagatggagtctccctctgttgcccaggctggagtgtagtggcgtgatttcggctcactgcaatctcagcctcttaggttcaagcaattctcctgcctcagcctcccgagtagctgggactacaggtgcccaccaccacacccggctaatttttgtatttttagtagagacagggtttcaccatattggccaggctagtctcaaactcctgacattgtga

SEQ ID NO: 709 - DNA, 314 bp, Homo sapiens
tttttaacccgtgtagattcctttattacattacccgagtttatatcagcatgacttgaatttgttgtattcagtttatctgattatttttaaaattttgtcacactcagagtgataccaccaatgagatgagcaccacagttattcaagccagcccagccctgtccaaggaataggcttagatcaagtgaagatccttcctccaaaagtggagatctgttggaacccagtgaggtggattggacgtcagacctcaagaaagtggaccggatcgggctggctctcctgagcaagtcaggtctgagtcgtcagac

SEQ ID NO: 710 - DNA, 378 bp, Homo sapiens
  misc_feature (228)..(228): n is a, c, g or t.
  misc_feature (232)..(232): n is a, c, g or t.
  misc_feature (239)..(239): n is a, c, g or t.
  misc_feature (268)..(268): n is a, c, g or t.
  misc_feature (288)..(288): n is a, c, g or t.
  misc_feature (372)..(372): n is a, c, g or t.
ccaactgttcataataaggaagttagatattattactgaatatatatcatgaatgtaaaaaaaaaaagttaaggccagcgtagtggctcacacctgtaatcccagcactttgggaggctgaggcgagtggctcacctgaggccaggagttttagaccagcctggccaacatggtattacttagtaaaaagtaaggaaaaaaaaaaaaggttagccagttgtgagggtntgancctgtantcccagctactcgtgaggctgaggcacangattcatttgattccagggnggcacaggttgcagtgagccaagaccgtaccactgcacaccagcctgggcaacagagtgaggactctgtctcccaccaaaaaantttttt

SEQ ID NO: 711 - DNA, 2809 bp, Homo sapiens
tttttttttttttttgctttcccgtttcttaaacattggcgttcccaagtttctccttggtcctcctgtcatttttatctactctcgtagcttcaaataccatctagtttatagtttatttagcatgttgtccaagccaccgtcttgggcccagggctctacctgtagcttttcatccacacttctcaggttgcttcttacacagcgccatagtagttaaaatacggtctggggatagtcgtctcttcatcagtctcccccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttcttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagtaaaaaaaaaaaaaaaaaaaaaaaaaaaaaaaa

SEQ ID NO: 712 - DNA, 461 bp, Homo sapiens
ttttggaagatcaagagcagctcaggccaggcatggtggctcacgcctgcaatcccagcactttggaacagccccttagttctcggcaaagcggcccatactgaggcacaccatgagggcagtagctcatctcagctttggtgcaggcaggaagtcaggaaggatggcacaggcctggcaggctgcctggaaactgtgcaccttcagcctccagcaggaaagccacccgtctgcaggctccctgccttccctacatctctgttcctcagtaggatccttgggtgtgctcatctcatccctccatttggtcaaggtttgcccatcaatgtgcaggacccaggcaagttcacggcctgtcctggagaaggggggaagcaatgacatcagcggcagtcccctcgctccttgccagtgacgctggggtcttaccagtggtgtttgcgagtggtgactccgaacct

SEQ ID NO: 713 - DNA, 437 bp, Homo sapiens
tcttgaaatggagtttcactcttgttgcacaggctggagtgcaatggtgcaatctcagctcactgcaacctccacctcctaggttcaagacattctcctgcctcagccttccaagtagctgggattacaggcatgcaccaccactcccagcaaattttgtatttttcatagagacaaggtttcaccatgttgtctaggctggtctcaaactcctgacctcaggtgatccacatgcctcggcctcccaaagtgctgggattacaggcgtgagccaccgggcccggcctagactgtgcatattctcttgaagtgtgtgtataataaacaaattaacaaaaaaaagaactgctttaaaatgtatatttaaaataaaatagttttaactcaatcccattttctgtgatatagttagccatactggttaatttctcaaatca

SEQ ID NO: 714 - DNA, 431 bp, Homo sapiens
tgcatcttgagaagatcgtgtggttttggtcttcttttaatatggtgtattacattaattgattttataaagcatgttgaaccagtcttggattgctgggataaatcttacttggtcatggtgtataatccttttagtatgttgctgattctgtcaatggcttttatttctatagtcatatgaaatattgctgtacaatcttcttttctcgtaatgtattttacttgttttagtatcaggtaatactggccacatagaatgagttggtaaatatttctctcccattttttgctagagttaatgaaagattaatgcaaattcttctgtaaatttttggtagaattcaccagtgaagccatttgatcatgaggctgagtagctgggattacaggcagaatggcacttttatcattataaaatgttaattgttt

SEQ ID NO: 715 - DNA, 500 bp, Homo sapiens
  misc_feature (11)..(11): n is a, c, g or t.
  misc_feature (29)..(29): n is a, c, g or t.
  misc_feature (281)..(281): n is a, c, g or t.
  misc_feature (325)..(325): n is a, c, g or t.
  misc_feature (345)..(345): n is a, c, g or t.
  misc_feature (435)..(435): n is a, c, g or t.
  misc_feature (500)..(500): n is a, c, g or t.
ttttttttttntttttttcagacggattncgactctgtcgcccaggctggagtgcaatggtgagatctgggctcactgcaagctccgcctcccgggctcacgccattctcctgcctcagcctcccgagtagctgggactacaggcgcccgccactgcgcctggctaatttttttatatttttagtagagacggggtttcaccatgttagcaaggatgatccccatctcctgacctcgtgatccacccgcctcggcctcccaaagtgctgggattacaggtntgagccaccatgcgtggccctgggacacataatttgtttaaaantaaagtgtgtaactaaggtntcaccgataatatatgaacagaaagaaaacttgcgggaaactttcaatggaacattactttcaaaggaaattttgaccttgttttttcgnttcattttcaagtagttttaggtttccgacattgtaatatggggttgtgatggctagggtagttn

SEQ ID NO: 716 - DNA, 307 bp, Homo sapiens
gtatttttagtagagacggggtttcaccatgttggttaggctggtctcgaacccctcaccttgtgatccacccacctcggcctcccaaagtgctgggattacaggcatgagccaccgcacccggccctaaacatttgttagacaatacttccgaatgttttgtctatgtaatttagttcacaaatcattcagctcataaatcaacttgtctagactcatgccctgggttcacagaattagaaataatactattttacattagggactactaagaacaaccaggatgatgataatagtcatcactaaa

SEQ ID NO: 717 - DNA, 322 bp, Homo sapiens
taaagacgtgttttgccatgttgtccaggctggtcttgaactcctgaattcaagtaatcaacctgtcttggcctcccaaagtgatgggattacaggcatgagccaccgaacccagccagcatcaagagttttaaaattaaggacataacgccatttcacactttaaatagactatagtgtagtgtaaacatagcttctttttttaaatagagacaggatctccctatatgcccaggttgatctcacaattcctgggctcaagtgaccctcccgcctccgtctcctaaagtactgggattataggcatgagccatcacaccca

SEQ ID NO: 718 - DNA, 406 bp, Homo sapiens
  misc_feature (267)..(267): n is a, c, g or t.
  misc_feature (304)..(304): n is a, c, g or t.
  misc_feature (329)..(329): n is a, c, g or t.
ctgtaattttatttttaaattatcttttaacaatacacttctaattttgttcctagccacataattcaagttaagtgtttccataaacttcataagtagacttagagactttattcactttttcagggaatagtgaacatatgaggctcttaaatagtaccagattataattatttaatctaccctataaaaggaaatttataaaatattggaataaagtatccttttaaatgtattattttagctacaaatgaggaacataaggantcagtatttttaaaccataaccatcaataagagaggncaggccagggcacaggggctcacgnctggtaatcccagcactttagggaggctgagacagggaggatcacttgagccccggaagtttgtgacccggcctgag

SEQ ID NO: 719 - DNA, 179 bp, Homo sapiens
tttgaaacagggtatcattctgttgcccaggctggagtgcagtgttgcaatcatagctcactgcagcctcgaactcctaggcccaacagatccttctacctcagcctcctgagtagctgggacgacaggcacacatcacaatgacgaggtaattttttgtataggcaaagtttgccatg

SEQ ID NO: 720 - DNA, 392 bp, Homo sapiens
ttttaatcttattgcttttaccgaggcaaagtctgttttgttgtttttgctgctgttttttgagacagggtctcgctcttctgctcagcctggagtgcagtggcccatcaaagctccctgcaacctcagcctctttgactcaagggatcctcctgcctcagccttctgagtaattgagactataggtgtgcaccaccatgccagtgatccccctgcctcagtctcctaaagtgctgggattataagcgggaccaccacacccagccaaggaatcccatatgcaacagagttatttaatttactctttgtatattgcttaaagcattaaatgatagctaaaaatcgaagtgtttggcctatcttctattcagctgggacacatgctgtgagat

SEQ ID NO: 721 - DNA, 425 bp, Homo sapiens
  misc_feature (1)..(1): n is a, c, g or t.
  misc_feature (69)..(69): n is a, c, g or t.
  misc_feature (251)..(251): n is a, c, g or t.
  misc_feature (356)..(356): n is a, c, g or t.
  misc_feature (363)..(363): n is a, c, g or t.
  misc_feature (387)..(387): n is a, c, g or t.
  misc_feature (407)..(407): n is a, c, g or t.
nctgttacattatgagaacagtccagggtaatgagattactatctacctttgaagacctactctatggngcactgtcagggaatgcagaaatgaaaaagcctccagtatgcttcagggtctaataaaatctactgtcctatcttttttgttgtagttgttgtttttgagacagagcctcgctctgttacccaggctggagtgcagtgacgtggagtggagtttgctcactgcaacctctgcctcccagggntcaagtgattcttgtggtttagcctcctgagtaactggggattacaggcgtttcaccaccaagcccagatgattttttgtatttttttgagacggagttccgctncttgttngcccgggtgggagtgcaatgggtntcggctcactgcaacctttngcctcccgggtttaagat

SEQ ID NO: 722 - DNA, 1267 bp, Homo sapiens
acattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaaaaaaaaaaaaaaaaa

SEQ ID NO: 723 - DNA, 375 bp, Homo sapiens
gtggattttccttttaatgcaaaatgttgcaatacaaaacaatgtggagaaagtcctgttcctcaggacactgaagggaggagtgaggaagagaggacagagctggacgtctcctcctatttctccctccccaagtcactctgaggggaagaacactgctgcctgctccctgggcctgccgcatacaaggttagagccctgggtctggggcatccttagcctgaaatttgttgacatggggcaggagagcaggagggaacattgagggttttgactcttcgggctctaaaaggattactcaggatctgggagttccgtatgaaacaaaggagctgaaagaatttgattgccattgctaaaaaatatagaggattt

SEQ ID NO: 724 - DNA, 1182 bp, Homo sapiens
tagttctccctgagtgagacttgcctgcttctctggcccctggtcctgtcctgttctccagcatggtgtgtctgaagctccctggaggctcctgcatgacagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagattggaccttccagaccctggtgatgctggaaacagttcctcggagtggagaggtttacacctgccaagtggagcacccaagtgtgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagtt

SEQ ID NO: 725 - DNA, 482 bp, Homo sapiens
  misc_feature (393)..(393): n is a, c, g or t.
  misc_feature (440)..(440): n is a, c, g or t.
ttttttttttttttggtgtctaatacttttacttcccagcagcataataccactttggtcaggttgaaccactgcacaattttgcagctctttcagaaaaataatgaaaacaattggaaagacatgatgtacatgcaaatggtgagaaaatgatactattgtccaatcctttcccgtaaatgtaaaatatccttagttcatctccaaactgtgtatttattataagcccttacatcagggattttgtttctttcagtttttgtagcaccaaatagacacagcggctaacaagaaataaatctgaaaagtcactgaaatatttatcacatgtcaggaaattttctggtctgtacctttaaccatgttcctgggcttcacatattcttcttaagngtaagctataacataaggttgagttcccacccgtgtttggctaccgntgtggtttgtttacctggataatactttgttaatatcctttg

SEQ ID NO: 726 - DNA, 1977 bp, Homo sapiens
cactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagaacctcatctcaagccaggcctcgagctacttcattgacgctgccacagtcgacgacagtggagagtacaggtgccagacaaacctctccaccctcagtgacccggtgcagctagaagtccatgtcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacaaatgacccccatcccatgggagtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagtaaaacaacaatacaggctagggatggtaatcctttaaacatacaaaaattgctcgtattataaattacccagtttagaggggaaaaaagaaaataattattcctaaacaaatggataagtagaattaatgattgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagccctctaatgctaggagtagcaaatggtcctaggaaggggactgaggattggggtgggggtggggtggaaaagaaagtacagaacaaaccctgtgtcactgtcccaagttaagctaagtgaacagaactatctcagcatcagaatgagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcagtcagttccaatgaggtggggatggagaagacaattgttgcttatgaaaaaaagctttagctgtctcctgttttgtaagctttcagtgcaacatttcttggttccaataaagcattttac

SEQ ID NO: 727 - DNA, 1345 bp, Homo sapiens
aaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaagggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattg

SEQ ID NO: 728 - DNA, 1048 bp, Homo sapiens
aggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcttcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagagcccctcactgtcaccttcccgagaataccctaagaccaataaatacttcagtatttcag

SEQ ID NO: 729 - DNA, 1158 bp, Homo sapiens
gcctgctgctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacttgccaagtggagcacccaagcgtaacgagcgctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttctgccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagtt

SEQ ID NO: 730 - DNA, 1171 bp, Homo sapiens
ccagcatggtgtgtctgaagctccctggaggttcctacatggcaaagctgacagtgacactgatggtgctgagctccccactggctttggctggggacacccgaccacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagttgagcctaaggtgactgtgtatcctgcaaggacccagaccctgcagcaccacaacctcctggtctgctctgtgaatggtttctatccaggcagcattgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccacctggctccaaagacaaaaaataaaaa

SEQ ID NO: 731 - DNA, 351 bp, Homo sapiens
ttttctggcagcataatttattcataacctactactccccaggaagggaagacagatggtttatctatttccaagttggaggttggaaaactaagatcaataggcatgatcccatggcaaacgctgctgtctggctgtgctccaaatcgctctccgcctttgtcctcctcccactcctggaaccacctttgtccagatttcttgtagactaaataaaatcctttttattgacctatcctctgttacttgtagccaaacacattcctttgaatttagttgcagtaaatagagcagcacagataatatctgaaaatacagaatggctgagttgaggtggcagggcagagagca

SEQ ID NO: 732 - DNA, 2406 bp, Homo sapiens
gattctgtgtgtgtcctcagatgctcagccacagacctttgagggagtaaagggggcagacccacccaccttgcctccaggctctttccttcctggtcctgttctatggtggggctcccttgccagacttcagactgagaagtcagatgaagtttcaagaaaaggaaattggtgggtgacagagatgggtggaggggctggggaaaggctgtttacttcctcctgtctagtcggtttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 733 - DNA, 1193 bp, Homo sapiens
ggggggccatagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccgtgcatctgtactccccttgtgccacacattgcattattaaatgtttctcaaacatggagttaaaaaa

SEQ ID NO: 734 - DNA, 418 bp, Homo sapiens
  misc_feature (178)..(178): n is a, c, g or t.
  misc_feature (218)..(218): n is a, c, g or t.
  misc_feature (241)..(241): n is a, c, g or t.
  misc_feature (271)..(271): n is a, c, g or t.
  misc_feature (373)..(373): n is a, c, g or t.
  misc_feature (402)..(402): n is a, c, g or t.
  misc_feature (416)..(416): n is a, c, g or t.
ttttttttttttgagattttgtttgtttttatttggggagaatgaaggaggagggagattttagactgaatcattctagagtatttgacgactacagctcctctctctttgtactacggagaccctgcttatagcccccaacaggaaatcctcatctgcggttgccagacagccagantatttccacctgtgccagaacaagacagaagaccccaggnagattcttcctgggggacaggtntcaagcagacccaatcccccatacagagantttcttaggatgaaaacagcctcaggcccttaggacccagcctctgggtctctcttctggggcccacaccaggcacaacacctggggagaaggccccaagcnttgcacaagtaccaaacccacccgggggnacagcaccaccttnct

SEQ ID NO: 735 - DNA, 1157 bp, Homo sapiens
gctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttc

SEQ ID NO: 736 - DNA, 401 bp, Homo sapiens
ttgtttttgcagaaattaaactgtatttattggtggcaatgcgatgggagaagaggaggtaatacagcaaccctcacaccactggtgtgaccattttggagaatagtctcttaatgtgtacgcaggcctaaagatccaacggttcttgcctgggtctgtgtccgaaataaattctcatatagactcaaagagcacatgactgaggatgtccatagttgcactgtggtggtggtggggtggggggtgggtagttggaggcaagccgagcatccatcacgtggcgccggcggagacggctgacgggtggtggagggaagaaaagcgacagagagcaagaggaagggcgggcaggcacgcagcgcgccgtgagaagcgagcgccggctcgagcaaaagcggagg

SEQ ID NO: 737 - DNA, 1339 bp, Homo sapiens
gcaggcattgtttgttcttgtcttggatttatgcctttaaatttcaccttttattacacagctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaagctccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaaaaaaaaa

SEQ ID NO: 738 - DNA, 1406 bp, Homo sapiens
tttttcatctctccacttctcctaataggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacaaatgacccccatcccatgggagtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagtaaaacaacaatacaggctagggatggtaatcctttaaacatacaaaaattgctcgtattataaattacccagtttagaccggaaaaaagaaaataattattcctaaacaaatggataagtagaattaatgattgaggcaggaccctacagagtgtgggaactgctggggatctagagaattcagtgggaccaatgaaagcatggctgagaaatagcagggtagtccaggagagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagccctctaatgctaggagtagcaaatggtcctaggaaggggactgaggattggggtgggggtggggtggaaaagaaagtacagaacaaaccctgtgtcactgtcccaagttaagctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcatgtcagttccaatgaggtggggatggagaagacaattgttgcttatgaaaaaaagctttagctgtctctgttttgtaagctttcagtgcaacatttcttggttccaataaagcattttaca

SEQ ID NO: 739 - DNA, 425 bp, Homo sapiens
  misc_feature (411)..(411): n is a, c, g or t.
  misc_feature (417)..(417): n is a, c, g or t.
ttatttagtttaataagcatgtggtttaataaggacacactctctctctctctctctctatatatatatatatatatatacacacatatatatatgtaaatatatacgcggagggagcatattctcagagggtgggcagaagggccagggctcatcttacttttaaaagagaataataaggaaaataatctggtcaattccgctgttgctgtttgtatttttttaaaatccaacacatttgaaaccttacatttagccaacactacccaaaaaaaaggtacatcctgtctctggaaatacccatctctggggatgtcaggaattgggaggtaatttttttcaggaaccggtgaccgggtcatgccccaattgccctcccccggaggggtatccaaggccacaccagtcctngggggncaccctat

SEQ ID NO: 740 - DNA, 391 bp, Homo sapiens
  misc_feature (243)..(243): n is a, c, g or t.
  misc_feature (309)..(309): n is a, c, g or t.
gggggttctgcagctttattcacaggccccaggggattgaaggcagcaaggacacagacgcgggggacgcccgggtattggcctctccacccccaggactgtgagggagcccctgacaggattgtgggggctggaggatgtggagtcccacgagcggccctggtgtgcaagagggcggagggtctctgcctcgaggggcctttctggcgctctacttccagcgcccgccgactttgcccttgnttggggtcccagctttcttgctgctgaaatgggaagcaagtgatccttcagggtcagggcctctgnaatgcccctcctggtcccccaccctgggcggactctcagcccgaccccaggctgctctcagggcacaggccggcccaagttt

SEQ ID NO: 741 - DNA, 545 bp, Homo sapiens
  misc_feature (7)..(7): n is a, c, g or t.
  misc_feature (17)..(17): n is a, c, g or t.
  misc_feature (36)..(36): n is a, c, g or t.
  misc_feature (39)..(39): n is a, c, g or t.
  misc_feature (67)..(67): n is a, c, g or t.
  misc_feature (498)..(498): n is a, c, g or t.
gggcttngggggcaccntagacttgcgcgagaatgncangctgtgtcagtgctggccgcagtccgcnggcgaacgaggtgaggcgcgtccggagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgttgtgtggctgtaaatggtaaaccctggttaggattatactaagccttttccgatatacagttgggcatggtaggtggtngttcaatgtgaaagccagttttcctacatgaggaggcccaaggttcc

SEQ ID NO: 742 - DNA, 1638 bp, Homo sapiens
ggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagtgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaa

SEQ ID NO: 743 - DNA, 463 bp, Homo sapiens
tttttttttttttttttttacataccatttacattttatcaggtattttaatgtagagatgatttaaaatatacaggagaatatgcataggttacatataaatactatgccattttatgtaagggacttgaacatctgcagattggggtgttcacagctaaacagactgctctgtgcagggagaggccctacagtgaagggaaaagtagacacttgattgtggactaatttgttcagtatttcccaaaaacttacagctaacaataatattaaacaggttttattagcatcttatacatctgacactctctcctaagcatccagtttattttctagtcacgggttacttactaaaagtctgtgtaacatgagctcacatcagattagaaaacatcaagtgggtagtatttttgactgaattaacatacaaaagaaattgcctatatcatgtatatgggctcca

SEQ ID NO: 744 - DNA, 1620 bp, Homo sapiens
tgggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccctaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccattgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaaaaaaaaaaaaaaaaaaaaaaaaaaaaaaaaaaaaaaaaaaaaaaaaaaaaaaa

SEQ ID NO: 745 - DNA, 948 bp, Homo sapiens
attgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccagctatttctaaagtcagcgtctcaccttaaaaaaaaaaaaaaaaaaaaaaaaaaaa

SEQ ID NO: 746 - DNA, 229 bp, Homo sapiens
gtgagcaccagataaacttttattgtgttcagccaagtgagatttaggtgtttatccatacagcaactagtgtcacctgaagggatacagagatttttctcccttttgctggcagctgcatgcagatgtgacacttcaaggcttaagagcagtgctgaccctgtagggtggaggagactggaggggaggtatccggagaagtatgagcaccaccagcagatggggtggt

SEQ ID NO: 747 - DNA, 1722 bp, Homo sapiens
gcgggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcaaagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggtttggggtgtggtgggggggtacccttatttcctcgacacgccgctggctcaaagacaatgttattttccttccctttcttgaagaacaaaaagaaagccgggcatgacggctcatgcctgtaatcccagcactttgggaggctgaggcaggtggatcactggaggtcaggtctttgaggccagccctagccaacatggtgtaaacactgtctctactaaaaatacaattagccaggtgtggcggcgtaatcccatgctaacctgtaatcccagctacttgggaggctgaggcagagctgcttgaaccctggaagtggaggttgcagtgagcctgtcatcgctccactgagccaagatcgctcccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgtaaatctttgacggggttttccttgctcctgccaggattaaaagtccatgagtttcttgctcaaaaaaaaaaaaaaaaaaaaaaaaaaaaaaaaa

SEQ ID NO: 748 - DNA, 4698 bp, Homo sapiens
ctgccactcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcacgtcaaaccccctcagcctgttggcttctgttcaccagctgcaagggtttacatacacggccaccgccatccaaaatgtcgtgcaccgattgttccatgcctcatatggggcccgtagggatgccaccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacaccgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatccctctttgccttggacttcttctcccgcgattttccccacttacttaccctcacctgtcaggctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccaggcctcagtctcccttctcccatgaggcacgaatgatctttctttcctttccttttttttttttttcttttctttttttttttttttgagacggagtctcgctctgtcacccaggctggagtgcaatggcgtgatctcggctcgctgcaacctccgcctcccgggttcaagtaattctgctgtctcagcctcctgcgtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagagcctctgtgcccccatcaccctcgtttccagtgaattagtgtcatgtcagcatcagctcagggcttcatcgtggggctctcagttccgattccccaggctgaattgggagtgagatgcctgcatgctgggttctgcacagctggcctcccgcggttgggtcaacattgctggcctggaagggaggagcgccctctagggagggacatggccccggtgcggctgcagctcaccagccccaggggcagaagagacccaaccacttcctattttttgaggctatgaatatagtacctgaaaaaatgccaagcactagattatttttttaaaaagcgtactttaaatgtttgtgttaatacacattaaaacatcgcacaaaaacgatgcatctaccgctccttgggaaataatctgaaaggtctaaaaataaaaaagccttctgtggaaaaaaaaaaaaaaaaaaaaaaaaaaaaaaaaaaaaaaaaaaaaaaaaaa

SEQ ID NO: 749 - DNA, 227 bp, Homo sapiens
ttttttttttttttccaaatcactctaagttttgttttgggtcctctgacaattgagtttccataatctggtcggctcagagacaccatcatgtgtggtatattcacaaatgcagacaaagaaaattctagaaagccaggggtgaaaaagctctcctttctcagacgattctgtgaagtctatgtgggctaaggagagaagaacaaaagtttctctgggccttggcc

SEQ ID NO: 750 - DNA, 1639 bp, Homo sapiens
ggcgcctgcgaacccgggcccgggggggacggcgcccgccaggagcgccccccactcccaggccagcccaccccggcggaccgggccccgcgcgcccaggcgaggtgaggcccgcgccgtcagggctgcgtgtcgccccgcgcccctgcccagcccgcgaggactgccccctcccccggcgcccgcccccacccccgcgccccaggtgagccccggagtccaggtaaggctccgcgttgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggttgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctgggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtggagacaaaaaaaaaaaaaaaaaaaaaaaaaaaaaaaaaaaaaaaaaaaaaaaaaaaaa

SEQ ID NO: 751 - DNA, 313 bp, Homo sapiens
aattgtgcatttctgattattttctcaaaaacatttaaagacaagtcaatgtgaactaaggagtgggaggaggtttcaaggaaaaggtagaacattttaagggtttttctgcagaggaaaaagtgagcaaaaaaaaaaaaaaggaaaaggaatttaagttgaaaaatactccaacaaacgaaccaacatgttttcagaactttttgaagttccagtatggtgctgtcatggttggtgagctgtctgtcccttgatcagtagacaatgcgagtttcttccgtcattcgccacgctgaccacttcccctctgctg

SEQ ID NO: 752 - DNA, 1990 bp, Homo sapiens
caaggagccatgccagctggacacacacttcttccagggcctctggcagccaggacagagttgagaccacagctgttgagaccctgagccctgagtctgtattgctcaagaagggccttccccagcaatgacctcctcattgcttctggcctttctcctcctggctccaaccacagtggccactcccagagctggcggtcagtgtccagcatgtggggggcccaccttggaactggagagccagcgggagctgcttcttgatctggccaagagaagcatcttggacaagctgcacctcacccagcgcccaacactgaaccgccctgtgtccagagctgctttgaggactgcactgcagcacctccacggggtcccacagggggcacttctagaggacaacagggaacaggaatgtgaaatcatcagctttgctgagacaggcctctccaccatcaaccagactcgtcttgattttcacttctcctctgatagaactgctggtgacagggaggtccagcaggccagtctcatgttctttgtgcagctcccttccaataccacttggaccttgaaagtgagagtccttgtgctgggtccacataataccaacctcaccttggctactcagtacctgctggaggtggatgccagtggctggcatcaactccccctagggcctgaagctcaagctgcctgcagccaggggcacctgaccctggagctggtacttgaaggccaggtagcccagagctcagtcatcctgggtggagctgcccataggccttttgtggcagcccgggtgagagttgggggcaaacaccagattcaccgacgaggcatcgactgccaaggagggtccaggatgtgctgtcgacaagagttttttgtggacttccgtgagattggctggcacgactggatcatccagcctgagggctacgccatgaacttctgcatagggcagtgcccactacacatagcaggcatgcctggtattgctgcctcctttcacactgcagtgctcaatcttctcaaggccaacacagctgcaggcaccactggagggggctcatgctgtgtacccacggcccggcgccccctgtctctgctctattatgacagggacagcaacattgtcaagactgacatacctgacatggtagtagaggcctgtgggtgcagttagtctatgtgtggtatgggcagcccaaggttgcatgggaaaacacgcccctacagaagtgcacttccttgagaggagggaatgacctcattctctgtccagaatgtggactccctcttcctgagcatcttatggaaattaccccacctttgacttgaagaaaccttcatctaaagcaagtcactgtgccatcttcctgaccactaccctctttcctagggcatagtccatcccgctagtccatcccgctagccccactccagggactcagacccatctccaaccatgagcaatgccatctggttcccaggcaaagacacccttagctcacctttaatagaccccataacccactatgccttcctgtcctttctactcaatggtccccactccaagatgagttgacacaaccccttcccccaatttttgtggatctccagagaggcccttctttggattcaccaaagtttagatcactgctgcccaaaatagaggcttacctacccccctctttgttgtgagcccctgtccttcttagttgtccaggtgaactactaaagctctctttgcataccttcatccattttttgtccttctctgcctttctctatgcccttaaggggtgacttgcctgagctctatcacctgagctcccctgccctctggcttcctgctgaggtcagggcatttcttatccctgttccctctctgtctaggtgtcatggttctgtgtaactgtggctattctgtgtccctacactacctggctacccccttccatggccccagctctgcctacattctgat

SEQ ID NO: 753 - DNA, 337 bp, Homo sapiens
aagtttatgctaattgatttattaaattcagaaatatttaccgagtacctgttttgtgttacgtcctgataatatcaaaatgaacaagacaccttccgtaacaaaagaggactattagctagttaggaagaaaattgtaaacagataattgtaaaacaatatgggaaggcagtgatagggatatgtacaaaatacaatggtagtacttgaatatctttcctaaactagtctggggatctgggaaggcgtcttggaggagttaatatctaagttgagctttgaagggtaggttaagagttgactaggatgagagaggataagcttgatttttcttttt

SEQ ID NO: 754 - DNA, 2178 bp, Homo sapiens
tgggatagcgcgagtgtccgcggccgagcagcagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccattgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcctggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagctcggagaactctcaggagagaagcttctgaccacggagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaatagagcattcattttgaaaggc

SEQ ID NO: 755 - DNA, 443 bp, Homo sapiens
tttgaatctttaatgaatatttaattaggaccttttcagacagtgtaatagttgggggaaaaaagatgcctttttccaacacaccactgagttgaagaggatggaaaaagtcaacagatgagtttcctgtctttcccgccagttcccttaaaccatttctgcttttcatttcttctccttttcttacatctctgcatctgtggactctcctgtcgtctccaggagcaaggcagagacacattcttgtctgtgagcagatgacttgtctagaaatcatggacagcctgcaagtccttccagtcctcccaagaatctgacatggttttaggcagagaagaggctcagaggcctgctgactcaacatctcttacaagcgcctttgagtttctccaggaagcgctgaggttttctcagaagtcaaaaaactttttctgtattgtttg

SEQ ID NO: 756 - DNA, 1496 bp, Homo sapiens
cgcactccctgctgggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgtttgacatcctttgagatattttattactaaaatctgcc

SEQ ID NO: 757 - DNA, 1338 bp, Homo sapiens
ggctgtgactgctgtgctctgggcgccacgtcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctggg

SEQ ID NO: 758 - DNA, 426 bp, Homo sapiens
  misc_feature (329)..(329): n is a, c, g or t.
  misc_feature (331)..(331): n is a, c, g or t.
  misc_feature (340)..(341): n is a, c, g or t.
aaggagtgaaaatattttctaatgttgtcatgtgctttaaagatatgtatgaaatgtctgtggatgaaataatatatctggtatttacttcaaaaataacagagatgagagaagtgggtacacagacaaagcaagattggccatgagctgataattcttgaagctggtgatgaggccgctggagttcaatataagattctgtgtatttttgtatatgttcaaattttttcatgatagaaagttttaaaaagttactttttttttgagacggaatcgcgctccgttgctaattttttgtattttcagtagagatgaggcctcaccatggngncaggatggnntttatcttctgacctcgtgatccccccgcctcagcctcccaaagtgctgggattagggattacaggcgtgagccgctgcgcccag

SEQ ID NO: 759 - DNA, 439 bp, Homo sapiens
  misc_feature (380)..(380): n is a, c, g or t.
  misc_feature (402)..(402): n is a, c, g or t.
ttttttttttttagagtaaagtctatattgttgtaatacagaagtgaaggtgagtgggagggaacaatataatgaagaaacccaagtcagatggaacaggttaaacatgaaggtgaattcagagtaccttccctcaaaccccacccacacccctgctgctgttcctgagtatgacctgagttcagggctgcagcttcttcacagacagctacaggaacaaggtctacctaggaaaaaaaaagaggtgggtgccctggtgcatctgtaggcactgggaaatgactatcttgtaggaggccattaggattagggaagatagggaattaggaggctgggaggaggaagtgtttcagtttttgaacttcccctggaacactttncccttgaaggggaggacccctngggtctttttccaggccttccctaggagaggacccct

SEQ ID NO: 760 - DNA, 416 bp, Homo sapiens
  misc_feature (366)..(366): n is a, c, g or t.
  misc_feature (400)..(400): n is a, c, g or t.
tttccatttacttgtttattgtttgtctccaccaaggactgtcaacctctgagagtaagtaccttaacgcagtccttggcagtcattggcatcgataggcatttgttgaatgaacagacaagcttttcttgactgcccgctatgttcaggcactgtttttggtgctggagactcggtggtgagcaaggcagacacagtccctgtgttcctggagtgactgaattgaaatccactcaggcgaacattttatttcctggccaccagtttcatgtcaagttgtatcttaactgtttcttgagagtgcccagtacaaatcttatttcatgtgtctaatgcttttctgcctttcttctcaaaaccatgganagatggtgatctctctgtgctgttgttagcatcnctcggtgaaatcgttc

SEQ ID NO: 761 - DNA, 3321 bp, Homo sapiens
gacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaatacc

SEQ ID NO: 762 - DNA, 2139 bp, Homo sapiens
agacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaag

SEQ ID NO: 763 - DNA, 534 bp, Homo sapiens
tttaaagtctaaaaaaaaccctttaatttcttccagttttaatttcttctgttgcacactgtttatcttaacaccacaccctccgcccgacaaaaaaactttttgcaatgatttccagttagcattggtccatgcctatcaacggaaaattgtgcagtctctgggataaacagctcgactttgtcaagggaaccgtgtatttttactagaagtcagattcacgtccggcctccaggcaagaatgcaggaaatgccagacactggcgtctcaaaagcagctttcaaagttatccactcacacagccggcctctaagcaaatactcttgagagcacttgttgttttctccaaatatccaaacagaatataaactcaaagctgtttcagtacagttggttaaaaccacgcatttatagtagtgatcagcattatatattgttttaaggagcataaatccatagtttataaggattgatatggttgtgaaggaaaatgtatatagttcagcctgagatgtcagtgttaacctataaaa

SEQ ID NO: 764 - DNA, 380 bp, Homo sapiens
  misc_feature (313)..(313): n is a, c, g or t.
  misc_feature (361)..(361): n is a, c, g or t.
  misc_feature (373)..(373): n is a, c, g or t.
  misc_feature (379)..(379): n is a, c, g or t.
ccaaatactgaaaggagactaagcaaggaagctggatatgaaatgtctaccttcttgacttacgggtcatgttgtggtccttcctatttccaccttaaaattgacaaggcctcgctcaaatttgtgctaccaatgatacagagtttatagcaaattttctaagggaagtatctgtggaaattttctcatgattcatgaaaaatgttattagaagtacaagtatcctgggaatcagtcatcagggtcctccctctaaggcccactggggaacaaactggaggtggtggttttatggaaaggattccttactggntagtgggtaagcagggctggtagaaaggccccatcatccttaggaagnagattccttccnactaant

SEQ ID NO: 765 - DNA, 383 bp, Homo sapiens
  misc_feature (285)..(285): n is a, c, g or t.
  misc_feature (351)..(351): n is a, c, g or t.
tttttttttagacggtctgccttcatcttttaatggccggtgcggtacagttagtggacagacgggggatgggacacagcaggggtgaaacagggcagtcacagccggggccggggatctggaagcgggggcgttcctccccctgggaaacaccgtctctggaaggacacccttaggatcccctgacctcagggtgccacccacacgggcctgggtgttctgggaggcccgggctgggagtgacccccagcccctccctacgttccaggggacccttgggtcttnttcgagtcccttgctgggatgagggtcaagaccttagggtcaagctgactttcagccaggggtgtngggggtcccggctttcgttaggcccccagaat

SEQ ID NO: 766 - DNA, 527 bp, Homo sapiens
ttttttttttttggggaaaatcttttattgtatatatttaaggtgtacaaatgatgttttgacatccattacatagtgaaatgattgctacagtcatgcaaattaaatatgcatttcctcacataattaccctcttttgcagtaagagcacctgaaatctactcttagaaaatttccagtattcaatacagcattattaactatagaacttatgctgtacatgagatctctagatttatacatcttatgtagctgcaactttgtagctttgaccaacatcctcatttcttccacctccatccccctgtgtgtttgacttttttagcttccacatatgagattacgcagtatttttctttctgtgtctggtttgtttcacttagcataataccctccgggttcatccattttgtcataaatagcaggcttttatcaaaaaggcaagggataacaaatgttgatgagggtatggaggaaaggaaaccctggtacattgttggtgggaatgtaaattagtaccccatttt

SEQ ID NO: 767 - DNA, 1701 bp, Homo sapiens
gagcaccgcacactcacttcaccctggttcaacacccccacgaggttgaccccgtcattatgttagagattatgcattttccacatagggaaactgaggctcaggggtgttaagtgactcacccaaggtcacacggctaggaagttgctgcacgctcctatgctccatttcctctgggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaa

SEQ ID NO: 768 - DNA, 485 bp, Homo sapiens
tttttttttttttttgccttttggcagtccttttattaaaacaaaagtaccatattgatatgtataaaaagaaactaggaatacagcaaaattaacaatggttgataagattacagatatttcactttccttatgcttttcagttttctatgttgaccttatgttacatttagaataaagtaaagaaaatgtatttaaaaaatcaaacctatatatcaagggcttgtttgttcatagaattatgggagcagaacttgtattacacagggttaacctatgagaggacggtgaggaactggatgctcagtgtataaacctaaaatgggtcttatagaattatagagtttaagtgtatttaacacagttttataaccgagatgtactgaacaatttctgggttcaccaaaccatggaatttcctcttcctgtccgaccaacaaaaatttttaaattcttggcagagattataagacattaagtgtgga

SEQ ID NO: 769 - DNA, 319 bp, Homo sapiens
tttttcagtcagcacaaactagtttatttggcaattcataaagatagggactcttcagaggaggttgagagcattgtagggttatgtaaagacttccagaagctgtaaagacttccagaagcaagaagattcaaccatctaaaacgccatgcaggaaaatagccaaaccttctccatttaagtagagaataaatcttagtagcgttctctgcagaatataacaacgctgcaaaaaggccatttcacaggaatataatcaaaactgcagattctcagggtttcccgtaagacgacttctctgctcttctgtttgtggttt

SEQ ID NO: 770 - DNA, 1168 bp, Homo sapiens
ggcacgaggccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccctgaaaaaaaaaaaaaaaaaaaaaaaaaaaaaaaaaaaaaaaaaaaaaaaa

SEQ ID NO: 771 - DNA, 344 bp, Homo sapiens
ttttttttttttttttcaatgagaaagtaggtttattttcctttaataaaattgtgctcctgggttcaaaatgccaggttacatacgctgccactcatttctacagagctatgctgtctccgcgcagacattctcatagacttgaaaacgtaaagtggccacaccacgtcaaacgtccctggcaaggttctgcttatcattagcaccacagatgtaaacattacgtcgacaaaacaatcggtgaatgtgatacacagtcctcatgtgtttaaatattagtgaaatctgataagtattacgattttaaaaacgtattttcttaattccaatttccaaattgatgt

SEQ ID NO: 772 - DNA, 429 bp, Homo sapiens
atgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatag

SEQ ID NO: 773 - DNA, 3984 bp, Homo sapiens
gaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgc

SEQ ID NO: 774 - DNA, 360 bp, Homo sapiens
tttttttttttttttttccttacaaatcttatactgcttcttctgactttctaaaaaagttgtcaaatctttcttctgctgggccaagatctgttgctggaacttcttctcatctgctgcagctacctttgcctccttttctatgatagccacttgcttcttggccagcttctccagctcgatggacgagttgttggcatgcgtctccacctccttctgtagcttgaggcggggctcgtccatctcagccttcagcttgttctccagggcgatcagctgcttctggtgctggcgccgcatccgcttataacctgacatctgttcccgcaactcgttctcctgctcatgctcatggatctg

SEQ ID NO: 775 - DNA, 1637 bp, Homo sapiens
aagaactggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttac

SEQ ID NO: 776 - DNA, 1542 bp, Homo sapiens
acaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatctatgtcaaatttttccatctttcatccagggctgactgaaactatggctaataattggggtactcttatgtttcaatccaatttaacctcatttcccagatcatttttcatgtccagtaacacagaagccaccaagtacagtatagcctgataatatgttgatttcttagctgacattaatatttcttgcttccttgtgttcccacccttggcactgccacccacccctcaattcaggcaacaatgaaattaatggataccgtctgcccttggcccagaattgttatagcaaaaattttagaaccaaaaaataagtctgtactaatttcaatgtggcttttaaaagtatgacagagaaataagttaggataaaggaaatttgaatctca

SEQ ID NO: 777 - DNA, 460 bp, Homo sapiens
attttaatttttttaaaagaaaatctaagtataaacattaaaaagaacccactgacccattagctactgtccaaaaatattactactgatattttggtaaaagcaaaattagctgccctgaataattttccttttcaggcataatctttgctacataagattgtctgtcattcaatatccaacaataggcatctggattagtgctattttgtctactgtggatacaaaagttgatatgaaatgtgatcttcatttaaatgaataatcaccaggctttaggcataaatgactgtatacatgacaaggtagcttgaaaagtatacaaaaaaaaaaaaaaaactaaatatttttccttggtttttgcatgttaacccagtcaaattaaatccagaacagaattactacattcaattgtctgataaacaagcaatgtaatttcaaaaaaatatatattatacta

SEQ ID NO: 778 - DNA, 370 bp, Homo sapiens
  misc_feature (138)..(138): n is a, c, g or t.
  misc_feature (255)..(255): n is a, c, g or t.
  misc_feature (265)..(265): n is a, c, g or t.
  misc_feature (282)..(282): n is a, c, g or t.
acttgtttgaggtgatttaggattaccaactctgggaaaaaatattcacagccacattataaaaaacattatcggcaggattcatctcctgctcctttagaataagaacttttcttttgtttgtggaactttggaatntacaagcaagacgttcattcatgctttaaaatgctgtttaacaattgcttagcactttaccagggagaatgtttctcctgagtgtttaccaccctattctgtaatacagttgagggnccacatcaangctatctattccttccngggcccagaggaacacacacatttaatctgaggtgcattgaggtaccacaggctgagtgggaggaaagggattaggggagggcaatta

SEQ ID NO: 779 - DNA, 447 bp, Homo sapiens
aaggtggattttgcccactctgggtgtcactgaccaaaggaattccatggacatagtgggttaaaggagagtcaaacattgatcaagtggggattgtgattgaagccactgggaaggcacagattggctgctttagcatcttagccaggtctctgaatgcatttgagatttattgactctccctttgtcatacttaacaatgccctgaatactgggtgttctgccactaccagaagatgccaagtttgggctatacccttgaggtgtttgtaaaccagatgcctcaaaaatcactacctcaacaagaacagttggtcaaatgccaccacaccataagccaagtcttctattttttcactctttatgattttttctttaaagcaatcgtctgtgtcaccctaagagtttaacactgcccactttactgtcttgatgaaaaagtatgtt

SEQ ID NO: 780 - DNA, 3469 bp, Homo sapiens
  misc_feature (1640)..(1688): n is a, c, g or t.
taatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccagggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacaccttnnnnnnnnnnnnnnnnnnnnnnnnnnnnnnnnnnnnnnnnnnnnnnnnngctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaatggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggcccccatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatg

SEQ ID NO: 781 - DNA, 2481 bp, Homo sapiens
cccggcgctcgctgctcccgcggcccgcgccatgccctcctacacggtcaccgggaccgtacttcaccccgtggtgaagacactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcattt

SEQ ID NO: 782 - DNA, 455 bp, Homo sapiens
ggcagtgaggttgtgaccatttccttgtagaagtctttacgtttgttgactccagcttctcttttgtaactgagaggcagttttgcctaatgcttaggagcttgagctctggagtcactcagaattcattggcacccctgctttgtcactgtctggctttgtgacctgcagcgagttatgtagcttccctttgcctcagtttcttcatctataaaatggggttagcaatctctatctcagtagattatttgaagataaataagatggcacaatgaatagcatgtagcacaggccctgacctaaaggaagtactcaaaaaattgaaacttgttattagcaactgtattgactgatgtcagtggtgggttccaacccagatgtgccatccacagtggctgccttgcaaggtctttagggcctgaggctattcaagtgtcaggttctcactggcaatt

SEQ ID NO: 783 - DNA, 1367 bp, Homo sapiens
ccggccggccgaagagttcacaagtgtgaagcctgaagccgccgggtgccgctgtgtagaaagaagctaaagcacttccagagcctgctgagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaac

SEQ ID NO: 784 - DNA, 3404 bp, Homo sapiens
gcagttcagacccccccacacccatcaaagagccgctcctcccccccgcaggcgccttcgccgcctccctcccttcctttcctttccgctcctcttccgacctgtccacccgggaggaagggagctggaaagggggcggaaacctctcccctccaaaaagcacaacaaaactgttcagtgcggaggagccgggttcgcccctgccggacagcggggggctttgttccccgcagttgtttcctgcccatttgacctgtcagctgctggggaaacgctgctgttgacctttggttgaactgctaaggcgattttgctgatttttctttctttttccgcgagggctgtcttttgctcctccaaatgagcccagtccccctcccttctccccaaagcgctccaagagaaagtgccaggaaggggcttgtcccggaaggcctggcggctgagcggggccaggtcctggttaggccaccagggtgggcgtccgcgccattgtttgagcttgtcggcgctggtgggagagatgagggcaattcctctgggacgcaagtcccctcgaatggccggggctggccgggatgttccccgcacggcgctgccctcgagtccccccgatggagagcgcgggcgcgccttccttcgctggcgtccaaacccgggaccagctagaacacagcagggctgggactgggttccagccccacgtggagtctggatttgttttgttgtgttttgctttccttcctggaagaaatcccgaggggaccgccctagagcggcagctccaggacctcggcccttgggcttccgggggtgcagccacttaggccccgctcccggggagagagggattattttttaagatttatccccagggcgcgcggcatttccctgtccctcgtgaatcccgttgagagtcctccctccccaacctcctccatttccccagccagaccgattcgagagccctggagattctgggcgaggctagtgactgggtagtacaggcctctagccccaccattgctctctctgtcttcagttccccaggagggcaatggcatcaaacagcacagctctgggggatgtcaatattgcataccttttctacctaaagggaaaatgactcgcttttctgcttgcaaatatggtagtttctgcttacaaatgtaatacaatgcccatgacagccaaggactggaagcataagttgctaggtcttacaggtgattttttacaatgaagcaaactcactatgttagacaccatttacattggatgtctccaactaacaaaagtaactaaagacagatgtaggtgtaaattgagagtgaaatttgaccctttagaccgtcacaacttccttgggcttatcctgggtgcttataggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgatgggaagaaaagttcactccaacggaagccagtttgctgaacatagcagatcgcccaggaggactgggagagactgcaaaccagttcgagcccccagcatggcgttaggtgtcagccagctggcaggaaggtccaggtgtctgtgttcagagtctcaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaa

SEQ ID NO: 785 - DNA, 477 bp, Homo sapiens
  misc_feature (13)..(13): n is a, c, g or t.
  misc_feature (201)..(201): n is a, c, g or t.
  misc_feature (384)..(384): n is a, c, g or t.
  misc_feature (410)..(410): n is a, c, g or t.
  misc_feature (435)..(435): n is a, c, g or t.
  misc_feature (456)..(456): n is a, c, g or t.
  misc_feature (473)..(473): n is a, c, g or t.
aactattaaatcntctttagtaaagacaatttcgctcatacaaaacaacagtttacaacaatcgagtgctggacacaccatctgagacaagggaggcgctgcaggcacccagcgccttcccccatacacaaagacgaccctgggcgcccctccaccacctgcccctgagggagaggaaaggtgaagtattcctgccacctntccctccaagggaagggggagtggggggccatggcacagacagcctaccccagctgctcctcatctgtgctgggggaggcccctccccttcaccggccccgaagctgagttgtttggggtgatgggcaaatggctgatggggcaagggggcaaagtcaggacatttttgggtgcaaagacttnccccttgacccaccaggggcacacantgggatttttgagggggagtttttnaaaagtgggccttgctttttncccacaaggggtagttnggtt

SEQ ID NO: 786 - DNA, 554 bp, Homo sapiens
ttttttttttttttgcattctgaagtcgtttttattcgataactaacaccataataaccagagttccatctgagaggagaggagagtgagaaggggccagaaccctttggtggctgagaagcctcctcaaggctatgttggggcagtagggaggcagagaggtgaagatcttagggaagcccctgacccagcctaggctgctgcccacagggcaggaggaaagcccaggaggggagacaagacctccctgttgcaaccaggaggctgagcaaggcactggtgtttacagcccacagcttcacccgggaggggcgagggctcctgccctgcgagagcctttaggtgtacagttggggaaagggcagttcagctgttggctggagccagttctccgggctccaggtggtgccagaggcctccatgaggtggaaagtgtaggcctggcgcgagcggtcagagaggttctgcttgctcttgtgtaccacttctgcatggatgaagaccagggcccgtctctgcactgaggtgggcacaaagaggctgttatccccggc

SEQ ID NO: 787 - DNA, 387 bp, Homo sapiens
  misc_feature (12)..(12): n is a, c, g or t.
  misc_feature (14)..(16): n is a, c, g or t.
  misc_feature (179)..(179): n is a, c, g or t.
  misc_feature (181)..(181): n is a, c, g or t.
  misc_feature (310)..(310): n is a, c, g or t.
  misc_feature (321)..(321): n is a, c, g or t.
  misc_feature (359)..(359): n is a, c, g or t.
  misc_feature (369)..(369): n is a, c, g or t.
  misc_feature (382)..(382): n is a, c, g or t.
acttccttcacnannntacgacaaaatttaagaggaataacaaatacaaattttctgttaagaacggaaaggtgcaaactagcagagtcaatactggtaaccagaaggcactaatccaaacacataaatttcaaaagctggttatattatggaataccatatatactgggcctttgccntnttggggatttctggcaataggcaataagcctcgtttctgtttccaattataacaacaaaaaggatgaggttactaatggaacattccacttacaggaggtctggggctatggttggataaattggaaancttatctaggnctactcctgtctaggggggccaattaaaagggtaaccncctctttttntcccggccggccnggggg

SEQ ID NO: 788 - DNA, 444 bp, Homo sapiens
taaaacaatccatattatttatttaatcctaagtatttttaaacactgctatcatgctacttcacctaattctggctgctgttcatttggggaatgctatattggactattcttgaaacaatatatataaaatcaagcaaggcacgtgacagtcaggctttaggttggagccaggcctcggaaaatgtttttcaaacaattttgtgtctatcctttcatcctgagctggaactattgagaatgtgatagaaaaatgcatcgagtggcttgttgggtcttgtaagggtcctacgactctcatactctgtaaatggaatgtgtggagagggttaggagagccttcaggtagtactagagatgctggagcctctgaggacctctgcactgagattcctaatgttaatctggcctctgccatcactgagggtacccggggcttggctt

SEQ ID NO: 789 - DNA, 388 bp, Homo sapiens
tttttttttttcgagatgaagtctcactctgtcccccaggctacagtgcaatggcgtgatctcagctcactgcaacctccacctccctggttcaatcaattcttctgcctcagcctcccgagtagttgggattacgggtgcatgccaccacacccaactaatttttagtagaaatggggtttcaccatgttggccaggcgggtctcgatctcctgaccttgtgattcacctgcctcagcctcccaaagtgttgggattacaggcatgagccatcacacccagccctccttcctttttaaggctgagtaatattccactggggcgtgggatggatggaccacattttgctcatccattcaccagctgatgaacacttggcttgcttcca

SEQ ID NO: 790 - DNA, 493 bp, Homo sapiens
  misc_feature (20)..(20): n is a, c, g or t.
  misc_feature (30)..(30): n is a, c, g or t.
  misc_feature (318)..(318): n is a, c, g or t.
  misc_feature (428)..(428): n is a, c, g or t.
  misc_feature (440)..(440): n is a, c, g or t.
  misc_feature (461)..(461): n is a, c, g or t.
  misc_feature (488)..(488): n is a, c, g or t.
tttttttttttgagacgganttgcccctgntcgcccaagctggagtgcagtaaataatttgggacatagttaaattgtcagacacagaaaacaagtaaccaaacctatagataacgaaaaactggcttcccaacttcagttctcaaggtatggttactaagtaaacatacagaaatttctcataattttcaattttcattgttccagctttactcgtgaacaaatgctaaatcagacatgaactgttatataggctacaggataagactctaaaaaagaaaactaaaattttgtaaaatgttagggctgtttcaggantatagggaagttttcctcttacctacttacaaacatgggtctattaggcggggacacaggaatctagggttattatcagtttgggtattgtgatatagggcaccgttccnttgtaggttccnccgtctgccgcgggggagttngttaaacgcctgggggggaggcttcantgttt

SEQ ID NO: 791 - DNA, 419 bp, Homo sapiens
  misc_feature (270)..(270): n is a, c, g or t.
  misc_feature (414)..(414): n is a, c, g or t.
ttttttttcacggtgaaaaatacattttaatccaaaagttttgaatattggcacttagaaagttatttacaatcaattttactataccctttgtgaataaagagataattatgtacgtgtagctacctatagttgtttctttccaactcaaacaccataactatgtggaaaaagggtaagagttaaagctgctgcagctcaaaatcattacaatcaacttagattctgcaaattttcccaggggttgaaaaatgctgggttaaatcaggncaaaagaggagggcaagtgaggtacaccccactcctctcccattttacggtgtttgctcccttactttaacccgggcaaaggacctgcaccctgaatttcttagggacaatttttcatattaccacaggggcctctttattatnggggg

SEQ ID NO: 792 - DNA, 389 bp, Homo sapiens
  misc_feature (80)..(80): n is a, c, g or t.
  misc_feature (261)..(261): n is a, c, g or t.
  misc_feature (331)..(331): n is a, c, g or t.
  misc_feature (348)..(348): n is a, c, g or t.
  misc_feature (362)..(362): n is a, c, g or t.
  misc_feature (376)..(376): n is a, c, g or t.
tttttttttaactgaatgtgtgatttattatgtttaagattggtttataaaggcttaaatatatctgtcatagttaacangttaacagcaaataaaggcaactttacaaaatcagtgtttccatacagtacaggactaaatgtggcaactgtgcattggaaaattaatatttcctcaatgcaaatatcaaatctgcagcaccatttagaagcttccactaaaaactcaagctgcagtatttattacaggctctactcagancacaaggctacctaaatcaagcattagagaaaaacagtgggagtcattcagggcatatatatggtcaggntttgggtacagggtttnaatttacttaaccnttttttaatgtccngggggttttcaac

SEQ ID NO: 793 - DNA, 471 bp, Homo sapiens
  misc_feature (361)..(361): n is a, c, g or t.
  misc_feature (440)..(440): n is a, c, g or t.
  misc_feature (453)..(453): n is a, c, g or t.
cattaaataatccatcatcacattagtacaatacaattttatattttttaaatatactatatatgttaaggataaggggtgaagttttcttcctttgtaatacctgttcaagagtttaatggattaggagattagtgttaaccttgaggataaaagtacaaatttgtctcattaggacacttctaccaagcatttcttaaggctatagtttaacatttggtttcaaaaagaaaaaaaaaggtttcatttaaaaaataatttagtgaattacattctttcataacttccaccctaattagttacaaagataagtctaaagattcttagttttgtgtactaatttacatttatatttaaaggnttaattttacttgtatcttaaaaccaagaattttaatgttgggaaaaaagagaacctaaatacatttgtataaagggcngtaaatggtcccntggccaaatgcccccgtc

SEQ ID NO: 794 - DNA, 462 bp, Homo sapiens
  misc_feature (332)..(332): n is a, c, g or t.
  misc_feature (382)..(382): n is a, c, g or t.
  misc_feature (456)..(456): n is a, c, g or t.
acaaattatatacatttatttttaataattttaaataacactcttgtataaattctttcatatattcaaatcatacacaaatttagaaatgcatgatgaagcctagtacagcatatgtatgagacacattttttaagtttgtgttagaattttagtcgacataaatacaagtttaatgtttcagaaacattccctaattgctcggcctataatttaatgtattatagagtgcttatgcctagcattacaacttgactttaaatcatttagcttttgggactaacttagatctgaagccctgggcttactttctagggctgctggctggcccnaacaaggtaacaattccctaccccacatagccccaaatatagggaacccnggggatggttccattataagtgggggggttaaggttcacccaagcatcccaaaaaagtggtagggacccagggnggatgg

SEQ ID NO: 795 - DNA, 400 bp, Homo sapiens
tttttttaaaagaatgatgcacattttaataaagcacagcacaaactgttctttccactccgggctggcagtgtatgtctatccgtcgggcccaccagctgctctgcccagtccaataacactttcccttccgcagcctcctcgtttggacccagccttaggggcccgcccttccgcctttcaacctacgccacttcactcctctcgtatcttgctggtcctgacccctcctgggcagcctttcccttgggccctgccctggtccatctctctaaccctctggtgattctccggtgaaattcacatcactgtgctggaccctggcaacccacagaagcggggaacaggaggaaagaggtggaccgacaagtaacatagaatacagccataggccacccac

SEQ ID NO: 796 - DNA, 453 bp, Homo sapiens
atcttatcaatagtatttaatgttttgaagaaatagaccagtgtacaaagggatagggaattcatttctgttaatgtatttattagttcttactaggagaagaaatgtaactattctcttcaaaaccgttaaaaatcaagcactgaggcagccacaccatcgtttgctccctatgttccgatatccttaagatgagctcaaagaaaaattaaatcttgattcagggtaaaagtttctgctaatccagttcttttatcataaccatgaaaaaaatcactgaaaattactttatacaagttatgcagctcagaatttttcttgatatttgatcattttgaaatatgactaagcttctgctagagcctctaaaccaatctcttgacttcatcttctctttcattctgcaaccaaacctgattaatcttctcaaagtacaactccagtcatattgct

SEQ ID NO: 797 - DNA, 459 bp, Homo sapiens
catggaaggttttattgataattgctaaaatttagaagcaatcaagatgttcttcaataggtaaaggaatgaacaaactgtggtacatctgtaccatggaatattattcagcaataatattgatatggaggagacttacatgcatattattaagtaaaaggtggttaaaaatctatatgctttctgattctaatcataagacattctggaaaaggctaaaatatcaagaaagtaaaaaaaaaattagtggttcttaggggtttggtggcaaggaggaagggatagaaaaagagctcatgaaagagagagggaagaccggtgtgcagagtacaaaggtggtcagtgagaaaggacattccagttggtggcaataatagaagccaaggcataataattgaaaatgcagaacctgattcaatcaggacaggtcaggctgtgttgcagaaactaaaatacaag

SEQ ID NO: 798 - DNA, 1356 bp, Homo sapiens
ttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctcccccc

SEQ ID NO: 799 - DNA, 541 bp, Homo sapiens
aagcttttaattctcatttagacttaacgcatagggcaaaagtagagtttacgccgatatccgcatcagaagcgccctctagaggaaaatgagagtccagaggcgcagattcagaaacaggtaccttttgttccctttctctgaacaccggcgggttgtcgttaatgtccttcacctccacgtccacatggaaaacctgcagcggcctgtccacgatcacctccaggtggatactgcactccgcgctccgcccgcacagcttctcgcggtcgatccgagaattcacaaacaaaatgccattctgcagatttacctccagaaggtccccgtgtcttttggacgccacccggaacaggcgcggcaccagctccgccagctccagccccaggtcctgagcgatgcggcccacgaaggtgccgtgtttggcctcctcgtagacggagtagtggagctggccgctccccacctcccaggctgcaaggagcagaagcgagagcagcagacgctgggatcccgggcctcttggtccgataatcaccat

SEQ ID NO: 800 - DNA, 535 bp, Homo sapiens
ttttttcatttccttccagtttaatcctccgtgctaaaacaatcaaacaaacaaaactagttctcagtttggtgtcagctgctaatgagctcagtttacaaaaagaaggggaataagtttgaagtatatgcatttttcagtaaaaggcttttagcggaaaatgcaggatgagttgctgattgatggcacaagcacatttttcgtaaacagcagagaatatagaaatgctaactctggggatcttgactgtgtcagtgctgagtcatctgcatttcccatattattttataccagcaggcctaagaaggcccagacagaaatcacgcatacaaacacctccacacagacatctcacccccacacagacatctgcctccttatgtccattacactacatagaaaagtccctccattcccacctggggctgctacacgcgccactttgtgagcaggttcctcaagatgtgtgactgatgcttgccaaaggtgaagaaagaacaggggcaaaaaggggaagagtccgctgtgagaatca

SEQ ID NO: 801 - DNA, 404 bp, Homo sapiens
  misc_feature (276)..(276): n is a, c, g or t.
caactgccaagatcctttattttttccaggccccttcctgcccactccacatcggggcagctccagcataagggagatgacatgatgaaggggctaagagtagggcctggcagcatccactgagggcccaaccagggaacagttgctagccgctctcttccatgcagctggagcactagcaaggccttccagaggctcccagggcgacctccacatcactcccgcttgtctctgccctccagggtgctccgggcctcctctccctgtgtaccctangaaggtgtgagggccacagtcctcctcaggtgaacctccctccccaagcccagggccctagcacaggctgcagttggacggcttcgagcttgcggctctgggcctgcttgccgctgggtattctgcct

SEQ ID NO: 802 - DNA, 1826 bp, Homo sapiens
agtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctgggcagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttgcccctgccacctcctgcctcaggtgtccgctatccaccaaaagggctcctgagggtctgggcaagggacctgcttctattagcccttctccatggccctgccatgctctccaaaccactttttgcagctttctctagttcaagttcaccagactctataaataaaacctgacagaccat

SEQ ID NO: 803 - DNA, 417 bp, Homo sapiens
  misc_feature (353)..(353): n is a, c, g or t.
  misc_feature (365)..(365): n is a, c, g or t.
  misc_feature (377)..(377): n is a, c, g or t.
  misc_feature (390)..(390): n is a, c, g or t.
  misc_feature (404)..(404): n is a, c, g or t.
  misc_feature (415)..(415): n is a, c, g or t.
ttttttttttaagatccttaaaaagtatctttaattgatgccaaatatgaacagatcgtaaagtgacagaagcaagtaaaattgcatagatgaaaactatgcgcatcaattaggttctcaattcataacattcaatgtccttgacctgacatattacacagttagagaagggagaatgcgcagtaggtgaagatgaggacacgtccttaactcaaggtgggaaggcaactgggcaaacttcaaggaaataaaataggcgttttttcaggcttaaatgggtttgttgtcctgatgggtggcactttaaattaatactacttcaatttttattttttaacctcagtaatactttntctttactattngggggcatgtcncctgggggtcccntgttggtctacttnccatctgctgnct

SEQ ID NO: 804 - DNA, 330 bp, Homo sapiens
cagctctcaagcgtgtgtttaattatcttcactgcttactaaggcatgagcataaacttgtaaatatttacaaagactttaaacaagagattgcacttaatattcccgtgagaaagcgtgtccttgagggttttgctggtgaaggcacccacctgtgtgcgtgcacaccgctccgctccacctgtgtaaccaggcgtctctctgcaggcctccccaccgtctgcatcggtgcatggactgcggccaggctctacttagaagacaccgggtgagtccatgaccagactgcaacctcgaaaacgggcccggcaacatctggcacatgaagtc

SEQ ID NO: 805 - DNA, 604 bp, Homo sapiens
  misc_feature (214)..(214): n is a, c, g or t.
  misc_feature (590)..(590): n is a, c, g or t.
ccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctntgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcanacattggttcacat

SEQ ID NO: 806 - DNA, 370 bp, Homo sapiens
aggtaaggagcagctttattcaaaaaagactattacagaccctctgaccatggaaatcttcaaatgtctaaaaatcaaattttaaaaaaagagtttaaaaaagaagacgtaaacagggctagcaggaactttgtgtgggagcagggcaaagggggtaggatgagcagatggcatgatcagggcactttaactggagatatgattttccctcctgtggttggccagttctcagaataaactgttaagtgggagatgttctgctttttagagcttgctcaagttttggggccagctaaagttcagggactggacctcaagtttctgaaggagaatgtctgttcccattccttttcctactgaccacttcctc

SEQ ID NO: 807 - DNA, 385 bp, Homo sapiens
ttttttttgcaacaaccaaaggactttctcaagacaaaataccagtgaggaccaattaaagcagccccaaatagtgtggatatgccggaggacttcagcgaggaggagacacgggaggcaggcaaggtgcaccacgggctgtggagaagacgtacttgagctgggtttgcaggaaggaatgcatctgggctggccagaggcagggaaagggcatccaggtcacggctgggctggagaccaaggttctgcagggtggagtccactcctccactgtagggtggagcaagccctgttcagaaatatagatggtttcaggcagaaatgtagaggcattttgctctgatggagcaaatattttcttctaaatagggactttcttctctcg

SEQ ID NO: 808 - DNA, 437 bp, Homo sapiens
tttacacaagatagaagtttatatccttctatgtcaaaatccactcagtcaacccaagagggaaagggacaagggaaagcaggccctttccttgtaaatacctaaccaggaagcttcaaataccacttccacgcgcattcgaccagccaaactagtcacatggccacatcttgcctcaaggatgcctgggaaatgtaatcttagctggtggtcatacaatcatctagaatttctattactatagaagataggggaatggtagttttcagcacagtgggacaagccgctgtgtacagtgggaaaaggactaaacttagagataagtataccagggtttctgcacctccaaaatgtaatgagaagagtataattattaattatagttataataattatattaccccaaggctcattttttcaactccaaataatgataa

SEQ ID NO: 809 - DNA, 379 bp, Homo sapiens
  misc_feature (13)..(13): n is a, c, g or t.
  misc_feature (230)..(230): n is a, c, g or t.
  misc_feature (235)..(235): n is a, c, g or t.
  misc_feature (238)..(238): n is a, c, g or t.
  misc_feature (242)..(242): n is a, c, g or t.
  misc_feature (292)..(292): n is a, c, g or t.
  misc_feature (301)..(301): n is a, c, g or t.
  misc_feature (328)..(328): n is a, c, g or t.
  misc_feature (352)..(352): n is a, c, g or t.
  misc_feature (371)..(371): n is a, c, g or t.
  misc_feature (376)..(376): n is a, c, g or t.
cacttggtataanttttatttgcatgtgtaaaaagtgtatataacaggaaacctcttaaaataaaaacatagtaaagttttaggaaaaatatgaatttagaaaatgggttgctttttcagatcacaaaaatactgatatatgtgtactaaattaccttaaactgttgaggtgttagagaaacatttttcaaaaaacaaaaaaagttggaggttggaggagacacaaaatntagangantganggtactgatatatgtcacacatgttttaaaatgaccacacagggcaggantctacaaanggattcaaattctttaaaattacaggnattgctaggaggattcccctaatnggtgttaatgggccatacntaacnttc

SEQ ID NO: 810 - DNA, 287 bp, Homo sapiens
tttttttttaccatttaaacctgtttattttataaacaacggggaaatgtagggcttgggctagttggggaaggactgagccaagaagccgaatctgttctagacggaggtgggaaggggcctaacggtcagggctcagagaagcggtttcgccttcttttccgcggagggatccagacacgaccgcgtcctgaggcggttctgaaaagccgggccccttaaacctctgcgtcgggggctgcctcccgacagttgccgtaggaaatgcaggtgctgggaggcctgcc

SEQ ID NO: 811 - DNA, 401 bp, Homo sapiens
  misc_feature (322)..(322): n is a, c, g or t.
  misc_feature (330)..(330): n is a, c, g or t.
  misc_feature (343)..(343): n is a, c, g or t.
  misc_feature (375)..(375): n is a, c, g or t.
  misc_feature (393)..(393): n is a, c, g or t.
  misc_feature (399)..(399): n is a, c, g or t.
ttttaaaatagtataatagatctatttacagatttgaaagtatttcataatagtttgttagataggtacacttctaaatgtttatatacttacatgtatgcataagtatacatacaaaaatagaaaaatatctagagagctacctgtaaagtttttaacaatagttaacatttgtgttaacttacagggaaagactttaactttttactttatataccctcccaaatgtttattaattcataaggagtgagtgcctgggggtattttaaaattccaatacattgcttgagcccgggggggtttgaggcccagcctggggggnaaacgggnggaatcttgtctnctccggtagggccaaaaatgggccccagtttngggggggccatttccccngtaggncc

SEQ ID NO: 812 - DNA, 570 bp, Homo sapiens
tatggaaagtataggattttttatttattcttaatggccgcatgatattccactgtgcggctgaaccaaaaatcatttaaccagttccaagttgttgggcatacagcttgttttcaatcagtcgctttatacataccagtgaaataaacatcactgctgttgctgctaaaggattctctggtcaccgactaggggtagacgtaactggggtgggccgcatggctctcagactccaaaatgtgagtttcatctgccttccactgttgttcttctcagtagaggtctgcctgcgccacctgtgcttctgagcccatctgatgcactagattcatctggaggagcaggtttctggcaaggaactgaatttgtgggttccctaggaatctcttgcaacttttctagtgtgttggcttctgatttctcccaaacacaccgacttggcaataataccgagtctgaattggaaaggcttcatgaatattaggcccagggcaaatttctctctggctacgtgactttgatcttcatgctgctggactgttgcagcagatgggtttgtactattttctg

SEQ ID NO: 813 - DNA, 1975 bp, Homo sapiens
cttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttcc

SEQ ID NO: 814 - DNA, 445 bp, Homo sapiens
  misc_feature (428)..(428): n is a, c, g or t.
ttatttcattatttttaaatatattaatgaaatgggaaatagataaaattcattttaaaaaacaagcctacaggtgaggccaggcagggtgcctcacccctgtagaccaagcacttttggagcctaggcaagtggatcgcctgagcccaggagttcgcgatcagactgggcaaaaaggtaaaaccctctctacagaaaatacaaaagttatccagttgtggtggtgcatacctgtatttccagctactctggaggctgaggtgggcagagtgcttgagcccaggaagcagaggttgcaatgagctgagattgtgccacggtactctagcctgggagacagagcgagactttgtctcaaaacaaaaaaaatgcaaaacataaaccactgactcaaaagttataaccacttattaaaataataaacaatntcaaatactaaccatac

SEQ ID NO: 815 - DNA, 307 bp, Homo sapiens
  misc_feature (268)..(268): n is a, c, g or t.
tccttcagacagttactgtttatttagctctttcatttcatttagagtgagaataaagaaatgtattacagcaatgaaaataacaaattacagctaccctcttatggatacaatgttgagcagaaaaggcaagatcataaaaaaatgtacactaactagatgatagctagactggtgtgttcttatgacaattgagctctatgctatgagctgtgggattcttctatatgtacattacacttcaattaattctttaaaggtatacccntatggattctatttgttagggctcccccaaaagggcccc

SEQ ID NO: 816 - DNA, 553 bp, Homo sapiens
  misc_feature (12)..(12): n is a, c, g or t.
  misc_feature (21)..(21): n is a, c, g or t.
  misc_feature (30)..(30): n is a, c, g or t.
  misc_feature (37)..(37): n is a, c, g or t.
  misc_feature (42)..(42): n is a, c, g or t.
  misc_feature (45)..(45): n is a, c, g or t.
  misc_feature (56)..(56): n is a, c, g or t.
  misc_feature (59)..(59): n is a, c, g or t.
  misc_feature (81)..(81): n is a, c, g or t.
  misc_feature (85)..(85): n is a, c, g or t.
  misc_feature (102)..(102): n is a, c, g or t.
  misc_feature (109)..(109): n is a, c, g or t.
  misc_feature (113)..(113): n is a, c, g or t.
  misc_feature (115)..(115): n is a, c, g or t.
  misc_feature (117)..(117): n is a, c, g or t.
  misc_feature (119)..(119): n is a, c, g or t.
  misc_feature (121)..(121): n is a, c, g or t.
  misc_feature (123)..(123): n is a, c, g or t.
  misc_feature (125)..(125): n is a, c, g or t.
  misc_feature (127)..(127): n is a, c, g or t.
  misc_feature (129)..(129): n is a, c, g or t.
  misc_feature (131)..(131): n is a, c, g or t.
  misc_feature (133)..(133): n is a, c, g or t.
  misc_feature (135)..(135): n is a, c, g or t.
  misc_feature (147)..(147): n is a, c, g or t.
  misc_feature (159)..(159): n is a, c, g or t.
  misc_feature (168)..(168): n is a, c, g or t.
  misc_feature (174)..(174): n is a, c, g or t.
  misc_feature (182)..(182): n is a, c, g or t.
  misc_feature (232)..(232): n is a, c, g or t.
  misc_feature (261)..(261): n is a, c, g or t.
  misc_feature (309)..(309): n is a, c, g or t.
  misc_feature (436)..(436): n is a, c, g or t.
  misc_feature (549)..(549): n is a, c, g or t.
aaaaaacccccncctttcccnaaacctttnaaaaaanaaggnggnggaaaaatttnaanaaggccctattgggcccggggncccnccccgggccaaaaattnttttgtntgtntntntntntntntntntntntnttggaaggaagnggggaaggcccnttaaggctnttttgnttccaacnccccaaggggcttggggaagattggccaaggttaaggcggttggattctnccggggcttcaacttggcttaaccttccnaaccttcccaggtttcaagttggattcttcaaggaaacttaggccagnattttggccagggcaattacagtaactttaaacttggatttctactggacatgtttataagttacccacatacctccaaaaacgtattaacagcaagatacaggactatctctgactttaataaggnacaaggtaagattgtgggagttgttgagctttctctttgccatatttttcagagaatatttatactaacaagcagcaaccaactaaataattaaaacagagtaacctagtggnaacc

SEQ ID NO: 817 - DNA, 309 bp, Homo sapiens
atttatttttaatttagtttcatactttagggcatatccactaaaaatgcatagacaagtgactgtgttttaaaaatacttgaagtaattctcctctgtgtgtttaggacaccaacacaattagtttcatttatttcatttagcttttgctttggatatatagttacgcacctcataacattgtttcagtcaacaatggaccacaatgaaccacgtatgcaccagtggttccataaggttgtaatggagctggacaatttctatcacctagtgacactgtaactgcagtgacatcatagctgtcttaat

SEQ ID NO: 818 - DNA, 2089 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaaggaatgatcatgaatgcaaagggaaagaggaaaagagccttcagggacaaatagctcgattttttgtaaatcagtttcatacaacctccctcccccatttcattcttaaaagttaattgagaatcatcagccacgtgtagggtgtgag

SEQ ID NO: 819 - DNA, 234 bp, Homo sapiens
tttttttttttttttttttccctttgcttaaaactttatttgcacagaatgtagggcctgagcacatctgcccacatttgcgtgctttgccacccattcatcccgcctgtcaccagaaagaggcaaaagcagcaggggtgagcaggcagcctccatctgctgagaacacctcaggcaaaaagggctcaagaccaggcttttttcccacccctccccacacagaagcatgttgct

SEQ ID NO: 820 - DNA, 2307 bp, Homo sapiens
agatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccctgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 821 - DNA, 468 bp, Homo sapiens
  misc_feature (346)..(346): n is a, c, g or t.
  misc_feature (379)..(379): n is a, c, g or t.
  misc_feature (394)..(394): n is a, c, g or t.
  misc_feature (401)..(401): n is a, c, g or t.
  misc_feature (432)..(432): n is a, c, g or t.
tttttttttttacaagtctcaagttttttattttcagaacagagtctggttttatttttaaaaagagaaggaaaaaagtgataaatgctagtgaggtgccacttccctccttcttccaggctctaaccgccagctagctctctttcacaaaacccacggatgcagaatcaggacatgttaaaatggaacagtctttagagagggtctagtctttttaaaataagtaaggatttggggactaacagagaggaagcccctgacttgctgaattgttagggagcaggcggttctcgagattctgagcccagggatccttttctgtgaaccatgcacgtgctgggcactnggccttcagggagacagtgccctgccttggctngttcaggtccacggnggaaatnttcaggttttgcccctttcactaggggattnccctaggaaagcaaagggcaaagggaagtttttagg

SEQ ID NO: 822 - DNA, 2292 bp, Homo sapiens
ccatgggttccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgttacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgtttttattatccacctgcagactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggcaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctacgagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaactttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcttgaatcacaaataaaagccaattgtatctgtt

SEQ ID NO: 823 - DNA, 3767 bp, Homo sapiens
cctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaacta

SEQ ID NO: 824 - DNA, 1579 bp, Homo sapiens
accaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattag

SEQ ID NO: 825 - DNA, 1752 bp, Homo sapiens
ggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccacttttttttttctgcctgagattctttaaggagatagacgggttgaaagacatcaatgaaac

SEQ ID NO: 826 - DNA, 1535 bp, Homo sapiens
gggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 827 - DNA, 379 bp, Homo sapiens
  misc_feature (128)..(128): n is a, c, g or t.
  misc_feature (158)..(158): n is a, c, g or t.
  misc_feature (161)..(161): n is a, c, g or t.
  misc_feature (184)..(184): n is a, c, g or t.
  misc_feature (202)..(202): n is a, c, g or t.
  misc_feature (329)..(329): n is a, c, g or t.
  misc_feature (374)..(374): n is a, c, g or t.
atcaaaatattttattttaggagacccctcaaaaaaagacccaccacattagacagacgccccaacaacacccttggcctttttttggtctttcctgtatttttccctttttaaatcaactaaaacantttgatgcttaaaataaaagacaggaaatnttncctgatgagactttagtcgagantatagatatatttctganccgggggcgggtgatcaggggcgggggaggagaaggatgtgccaccagtggttcgcgaggttccgtttctcagctcaggagggagcctgggctgcctgggacccgggctagggacccagagctgggnctccacagggcctgaccagggccaggggaaggaagacggaggagngagga

SEQ ID NO: 828 - DNA, 2263 bp, Homo sapiens
tgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggtgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgttaaaaaaaaaaaaaaaaaaaaaaaaaaaaaa

SEQ ID NO: 829 - DNA, 287 bp, Homo sapiens
taagccactgctttacttcttcaggttagcaaaatgcttaggtaaatttgttggccatcacaaatgtgattgaggccaccggtttctatcatcaaatgaaatcacaatgacaggtttctgacaataaactcaacctaaggggagcgctaataaattcccttcccagcctcttcttgggtgtgtggtatgtgtgctgcctactgaaatgcccaggatggccaccctcccacacgggatattctaagccgctgacaccatctaacttttctgaaagaaattaacaactc

SEQ ID NO: 830 - DNA, 459 bp, Homo sapiens
aagttcagaaagaatagtttttaaaaatgcatgtaatttgcatatacaataatcagctatttcttctagctcaagaaaacatttaaaacaaggctggtgctgctagtagcattcagaagaacacaaatttcttgccccttacattacaatgggagctctaagtttttacaatttccttttgactctggggagtgaggggctccttaaagcagctaagaaagaactcagccactaattcatagataatggaaatgcaaatattcactttgtctagtatagtcttatactatccgcccatagtttttaggcacaattattaagttttctcctaggggcaaaataaatcattcagtgcaatgaaaaagattcttgatagaattaagtttcagtaacaacagcaaaattatgcatacataatacatactttaaacatgaataaaacctaaatttttaacatgc

SEQ ID NO: 831 - DNA, 302 bp, Homo sapiens
tttttatacatatgctgtgatttattaagcatgttacgggaactttaaaacacctcattcagcagaaaggaggcagaggattataatcctcatttgacagatgggacactgaggcccaagtcctcatgttccttcagtctagaaagtgaagagaacttgcactgtgtgacaagggccaggcgaaagacacaggagaggaagatagattcctgtagaccttgtttgtcagggaagatcccttgggaaaggtcagtggttgaattggaccttgagggacagagaagtttttttttttttaagca

SEQ ID NO: 832 - DNA, 272 bp, Homo sapiens
  misc_feature (206)..(206): n is a, c, g or t.
  misc_feature (209)..(209): n is a, c, g or t.
  misc_feature (212)..(212): n is a, c, g or t.
cattttggcatttaattaagccatttattgcttcaaatgtgtcaccatgaacattttgatatacactccatagcagtaaggcctcaattttcaccacctgtgaactgtgaacccacatttggatattttgtcccaactgttacatgagttttgtacaacagagattttgaatgtgtattttataataccaaaaatacttactatgnccnccnccccttggtgtaaatgtcacaaagaatattaatagtttggccacatttttgggggggtga

SEQ ID NO: 833 - DNA, 421 bp, Homo sapiens
  misc_feature (180)..(180): n is a, c, g or t.
  misc_feature (399)..(399): n is a, c, g or t.
  misc_feature (405)..(405): n is a, c, g or t.
  misc_feature (411)..(411): n is a, c, g or t.
gaaatgagaaatgagggatctttcatggagttcttacacattggctacgaaagtgtttccctgcaaagagaagagtcttactgggtcatcacaaaatgatggggagtgcagagggaaggtgggatataaggtaatcaacctggataacagtatgcaccttggatgttagcaaaagcgaantaattagcttataaaaaacacatgaaatatataaaataaaatgattttcatatacatcttaatttaaaataattaatgcatcaaatccctgtttaagactttaacctgaatatcaaatttaagagtccagactagttactgttactgtggcccttccccacatgtaacacacacactatccaaaaatattttaaaaaccttcaccttcttacatctaantttagnggggtntttctcccgg

SEQ ID NO: 834 - DNA, 3144 bp, Homo sapiens
tgggcagaaggcagaaaaccagcagagtcacagaggagatggccaactgccaaatagccatcttgtaccagagattccagagagtggtctttggaatttcccaactcctttgcttcagtgccctgatctctggaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacggtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 835 - DNA, 303 bp, Homo sapiens
  misc_feature (150)..(150): n is a, c, g or t.
  misc_feature (255)..(255): n is a, c, g or t.
  misc_feature (274)..(274): n is a, c, g or t.
  misc_feature (287)..(287): n is a, c, g or t.
ttttttttttttttgaggaattaacagtctttattaaggctcagatgaaaattgtgatttcctggaaggacaggagcaaatggcaagtgggtggctcaaccctctagtccagtaatgaagcagaaatgacagtgtcgctgagttaaatcngacccaagcttgatcctcagagcagaacttgaatgatgtaagaagggttcatttcctgaaggaaagagaataacccccgccaccacctcccacaccccccaattncaaggcagatctgtcaagnctcatggtttcancccaacggacagcact

SEQ ID NO: 836 - DNA, 406 bp, Homo sapiens
tcaattaacttatttattgtccttttctctcataagaaagtacattcccctagaataacattgtagcttagagccaaagatcccagaagctcccttcttggatctcaagtcagactccaccatttactagctctgtgactttagggtaagctgcttctcttctcagagcccccatatgttgatctattgaagagaaaaaaaaagcagcacccaccacaaagggctgttataagaaattaaatgagataaatgtaaagtgcttcaagtgacagagtaatcaatattgcccattaacatttactgaagacttagagtgtgctggtatcattctcagaattctgtaagtattaactcattgtattccttacacctcatgagattaaaaaaaaaatgaggccccaaaaag

SEQ ID NO: 837 - DNA, 218 bp, Homo sapiens
tgcggccgcagagggagccaccagagactgaagcagcgtgaggcgaggtcaccagccgctccctgtggggtgcgggcagaagagactgcacgctggggagtggggacagcctgatggggcagggggcctgcaaaaatatgtctgttggttcctgaatgtggtgtgtccttgtcctcctggatctggccgagtgcatgtgtccccccacacctgtgcca

SEQ ID NO: 838 - DNA, 414 bp, Homo sapiens
aatttataaaggaaagaggtttaattggcacacagttcttcaggctgtacaggaagcatgatactggcacatgctcagcttctggggaggcttcaagaaacttacagtcatggtggaaaacgaaggggaagccagcacatcttacatggccagaggaggaggaagggtggagggaggcactacatacttttaaacagacagatttcatgataactcactcactcactgtcttgaccaagggagatggtgctaaatcattcatgagaaactgcccccatgatccaatcacctcccaccagcctccacctccaacattggggattacaatttgacacgagatttgggtgaggacacagatccacaccatattagaggccatgggtaaaaatgctctgaatgatttagaaaactaaa

SEQ ID NO: 839 - DNA, 4655 bp, Homo sapiens
  misc_feature (3605)..(3740): n is a, c, g or t.
cccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgaccgagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaaacctaaaaaatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttc

SEQ ID NO: 840 - DNA, 468 bp, Homo sapiens
tttgaaagaaaaaaacttttaatatggaatacagaattaagagaagaggtgagccgcagtgactaggtgatagaacagaagacgctaaggaatctattttcagttttgcacttgcttgtttcaaagctcctctcagagtaaaggtcccagaaatgaggaggggcagacgtctcctgcactgagctctatgtggagctgtggccatcctgtggccaggaggagtgtgcaatctcggtctgtgctcctactggatggcaggcagcatgttaggaaactgcacgcaggtcacaaggaggcagattatctctgcgcaaacttagccccttcaactagcgaaccctggagcctcggtcagaactaaacagtactctgatttcggaaaggctgctgttgtgatggccgatccctatgtgtgtggctttctcgagttattgcagatgcaccagaatctacgtgaactgagcctat

SEQ ID NO: 841 - DNA, 285 bp, Homo sapiens
ttttttttttctggattggttattttattggcatggaggggaaggtggagggtgttgagccgactacactcagttggaatgggtggcctgcaagtcgtagtgctccagcttggccaccagagagccggacagcttgatggtggcacccagggtggctcgcccaggtggttggtggatgtgctcagccaggcagagacgttgcgtggcaggcggcgatggcgtggctggtggtggcagtaacacttgcagggacaggagttaagcacctggaagggcagccagtgg

SEQ ID NO: 842 - DNA, 415 bp, Homo sapiens
  misc_feature (334)..(334): n is a, c, g or t.
  misc_feature (348)..(348): n is a, c, g or t.
  misc_feature (360)..(360): n is a, c, g or t.
  misc_feature (383)..(383): n is a, c, g or t.
  misc_feature (388)..(388): n is a, c, g or t.
  misc_feature (410)..(410): n is a, c, g or t.
ttttttttgggagtactttcacgtttaatacgcaagggcataaaatagaatgttaggaaacaatttggatttttttccctaaaatataggtgactatgggctagtttacaactttccttctctcactgaaataaaaatacatagttaaggattagggacgaatacataacaggtgacatttgacagtttgggcatattccttgttactttctaatcttgagaatcacagtttgctgttttaggaggtatctgaggaggttccagataaaaagcgatggctaaatgctcttaaactttgaggcgtgctgggatgctctaaagtagggagagggantttattaaccggangcttacaatgtnggaacccggacattcccgggccntctgnggtcttggccatgaggagggcnccggg

SEQ ID NO: 843 - DNA, 409 bp, Homo sapiens
tttaatctatcccttcgcctttggtaacgcactgctttgaaatgttattgactacttagttttactaaacacagagcccttccaagttatacatcgaacacagttaggtttcatattgaatgaggccccttcatattgaatgaggcccctaaactgtgattatcagggcagtagctgtactgggccgtaggcgccctctgttggcgaggcaggatgcttgctgtctaattaaataaattaaaataaatctaactcagtttattccatctcagaaaattaccttcccttttatatgttttctctttccttaatctcaagttgtatggcatatgtatattttttaccttttctcaactctgttccttcctacttgcctcctgcactgaaaacccgagtttaaacaaggctg

SEQ ID NO: 844 - DNA, 308 bp, Homo sapiens
tttttgttttttctttttctttattttctttcatgtgtatgtgctgggagtggggttggaggagactattgatcagagaaggaaacaaagaccaatcttctacaattccccacaccgacatttcttccagaagatcccattaaggttgatgcagtgcagtcaccatgcactgcccgttagacacacagaccagccacgttcttggccactatcagcagaatatgcatctggtccctttcctggatgtgggatggatttgtgattattgtttttggatctatgaccaggatccctgtcctggaacaaag

SEQ ID NO: 845 - DNA, 532 bp, Homo sapiens
tttaccaaatatagccaattattatttaccaacggtaagaggacaggtaaataagtaattcaaaagcacagatacttccagatctacattttagcctgtggtttcaacatcattctacacctagccacatttcagaggcaagaaagagggaaaattaactattttggtttatgtctcctttgattcccttaccctctagtacagacactaagcagcaagaagagatgggaagaaatgaagacggcacctcagtaatccagagagcaaaacagtcagccactgagtaatcaaaaatcatactggctgcggggtcacacaacgagtaacagtgcctttgagtttcaataggaagcaaaacatcacacgaattatagaaacattttagatcgaacccctaggacaaaaacacatgaaaagcaaaaaatacagattgttcggttttaggtctaaacttctctaaacacagccatcagacctgtcctaaaaccgctattcagaagtcatttccactctacagtagcaggacttggtg

SEQ ID NO: 846 - DNA, 942 bp, Homo sapiens
  misc_feature (499)..(499): n is a, c, g or t.
  misc_feature (848)..(848): n is a, c, g or t.
  misc_feature (851)..(851): n is a, c, g or t.
  misc_feature (874)..(874): n is a, c, g or t.
  misc_feature (881)..(881): n is a, c, g or t.
tttatattatagcctcttttagctctttaagtcttctatgggtttaatgggaggctttagtggtgtatagagggtgtgtgtgtgtgtgtgtgtgtgtgtgtgtgtgtgtgaaatggatttattttattctacaaatgaaatgaataaaatcacctgaaatggaacggaatggctacagcgagtgtccaaagaccacaaaactgtttcctgacatgtgcttagcatatttaaattgttctcacagtatcatcctgagagcagagagagcagtccaactgctccacaggactgcagagagggaaccaatccatctattttctcaataatggtgatgacagagatggaatgctgattgccaaatcccaaacacatacgggcctctcacccaaaggccatgatgcctttgtcttaataacagaataaacccaatcctgtacaaacagcttcttcagggtgcatgttttgaatggggcaaagattagctttttgtgggaggctntccaggataccggacaaaagcatgcactagagactcactaggtagattcaaatatctttctaccatttactaactgcttgatcttagtcaagttacataaaaggggctgtgtggggaggaggggctcttgtccacatctgtcaaagtatgaataacaattacaccctaactcgaaagtggctgtgaagactgaatgaagtactacctgtgaagtacatggtatacctgtaggtgctttaatgtcacctattaaatgctgggggtgatgaggatcaaatttcgccagggacccccacccgagggtataactcatccccccttttcacacgtgcctcgatgctaaattatntcntcgaaatgggcttactttttcantccattntcgacccaggcctcttgcagcttggggaatcgaaatcttaccggaatcctttttcatcgaa

SEQ ID NO: 847 - DNA, 374 bp, Homo sapiens
tttattaaggataaactttatttaaggataaactttattcaaatcttgtattagaatacttccaaattcaaacagaatgttagtcaaatgtttagacaaacaggcaaagattcaaagtcaagacaaaaattctgaaggagatcctgctaaaaagctatcctaagtagaatcaaataatgtacttgtcatgagcccttatttttctattttaatttaaacactgtatttgaaaggtaccaaaatagtttttgaaatgtaatgtgttagtaaactgtttagcaaaataaatcctcccaactaattagaaacgtaagacaataaagacgaaagatcccagatctgtatatataacaggatcactataaacacacccc

SEQ ID NO: 848 - DNA, 497 bp, Homo sapiens
ttttatattattccttaggcttcagttttaatctcatgttcaaaattaagataatgcattgtttacttctagtccacgatttgtttttgtatggcttgctacttaagaatgatttttacatttttaaagggttgcgagatgaaaatgaagaagagagagagggaaataaagaaaaagaggaagaagaatatgcgacaaaacttgtatgtgaccagcaaagttaaacattcattttggctaaggacagatggaataaattatgggaaaaatgtgatacacctgctggatagtaacccctcagtaaatagtagctcccataattatggatattgctattattttctaattactgtttttcttcatatgcgtggaatttgagaataacaatagctaacatgggataatttacaaaatggtgtgagataaacacaatgaaatgaggtaaatcagtgtgaaggagaaaggagatgtgaccctaataccaatgactacttatt

SEQ ID NO: 849 - DNA, 569 bp, Homo sapiens
ctgacataccatgatatagtaaacttgaacttcatgaatgaaagcctctgcaaccatttaacaatctgaaaatccacacaaaatttaagaccaccatattactaaagacaatctactcaacaatctaattacagaaagattactttaaagggctttaaaactaaaaagaataattaacagtaagagattagagcatgcccaagtcctctgtctgatgagaggggagagttctgaggagatcagctcctatcaggatgttgaagaaactgaacaggtatgtttgaagttggaaaggaaacattagtagagttgttcaattctcagaacaattgaaatataagtcagcttgccccatcactctgtttactgaggaccattagtgagttacctttacttcaaaaacggaaagaagaccaagctgtggaatgaccaacctagcaagcctatctatagttaaaaataaatttaaaatagaagcacaccatcacatacaaagataagaatactccgtattcatacaattacagatacactaattcatacaccaccccccaacagataaacttaga

SEQ ID NO: 850 - DNA, 364 bp, Homo sapiens
tttttttttttattttacataatatttataataaactttcttatcacaagttcctcctcagaacacactctacaaaatgtccgactgaaaagcttccaaaataattgaacacaagatatgaatcagcaacagaataagctcaagggaagagacatgggcacaggcaggcaaaacgtgatcaccacagctcccgttcctgcagtgacacttaacatactcagcatcttcatgaattctgaataatttactgatccgtaaagtctaaaagtatcaatttcaggtgagcagttttaaatcagaaaatagtcaataagttaatcatgactcttcagggtatttccttcacgtcctctgaagagtttcc

SEQ ID NO: 851 - DNA, 331 bp, Homo sapiens
tttcaagattaagcagcagtttatttgaatactctatatagtaaacatttgaagagggtgggtgggagagtggaaggggcttctcagggaagtgtccaaggcaggacagggcaggaggccttggcggatgacctgtttacagggccgtggatgcccggaacttctgggtcaaacagaacacggcggccgtgagggcgatgcactgacgggccaggagtttcacactcaggtcgtggtagcctctctcgcaggtcgatttagcagcctctataaactgatggtaggtgtacaccacatccctcaggttccccgctgccgccctgtgccgggc

SEQ ID NO: 852 - DNA, 233 bp, Homo sapiens
  misc_feature (132)..(132): n is a, c, g or t.
gcgaccgcacctaccgcacgctgctgcagctcaccaggatgtaccccggcctgcaggtgtacaccttcacggagcgcatgatggcctactgcgaccagatcttccaggacgagacgggcaagaaccggagcnagtcgggctccttcctcagcaccggctggttcaccatgatcctcgcgctggagctgtgtgaggagatcgtggtctatgggatggtcagcgacactgactgc

SEQ ID NO: 853 - DNA, 529 bp, Homo sapiens
  misc_feature (484)..(484): n is a, c, g or t.
ctcccaggaatttcctagacggatcctgtaataactttcattcttagttctaagcctagatataacagacccctctgtcatcgcaatggtgttttccccaagatgagacattctttttaaggtatgtgactctaagaatgggaaagtgaggggaacaggtacagtcatgtgccacataatgacgttttggtcaataagagaccacatatacaacagtagtcccataacattaataacacaaagctgaaaaatttctatcacctagtaatgtcacagtggaagcattactcacgtttgtagtgatgctggtgtaaacaaacctgcacagccagttgtataaaagtattgcacatacaatacatgaaatacataatacttgaaaatgataacaaatgaatatgttagtggtttattgtccacgaagacctttcagtgggacggcatggggaggggaaagccagtgataatgacgatcctaaccctncacaggcctagactaacatgtgtttttgtgtcttaatgtttaaca

SEQ ID NO: 854 - DNA, 3136 bp, Homo sapiens
gcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 855 - DNA, 430 bp, Homo sapiens
  misc_feature (105)..(105): n is a, c, g or t.
  misc_feature (107)..(107): n is a, c, g or t.
acacagtatgatctcattttattgctgaaatggattattctgcacaggaacatgcctgggatttgtaaagcgagcctgccctagaagagaggcacacggccgtgnancacctacctgggatgatagaaaactacaggcataagtcaggaaaggaaaggagtgaacaaaaccaccaggggctggcttcgctgtcaaaccaggctgcagagaacttttctatttctacagagcgcgtttccaggaactaaataaatgaaaaccataaaggggagaccctgcctacaactaaacgatgcctggccacgcgtacatgggcaggtggtagcggttatagtgcaggtagtcaagagtgcttctctccaccagggttttgtagatggattcctcaaaaactcctttgaggtaatgcctgggcttctcagtccgggtt

SEQ ID NO: 856 - DNA, 524 bp, Homo sapiens
gtccttatgaaaccatttcttttattgtaattgggaattatcaggaaattgaatcaaccagaaatatctatgccttcttgcattcccatttcatatcgaatctatataagttgaatgaaactcctctgaagttaggccaagctgggatgaagttccaatccagtcataactgttggacctgcagcaagtactcatccttgccaaacctttgttttctcacctttccaggccaggtagtcacccttgcatgtttcccttaacattctggggttactgctgtcattgcccctcttacactgcatcaagatggttatttacgtatctgtctcccctactttggtgtaagtttcttgtaaagagagcttgggtcttgatctgtgttatttttgtagctttatttctagcaccatatctagaccttttaaaatgcattcttctggatgtgagcatcttgaggacagggagcatccctacatcttcacagcataggcactcacatattcaattcattgcagagcttcatt

SEQ ID NO: 857 - DNA, 452 bp, Homo sapiens
tctgttttaagatcatttattagaacagtcattcagaagccattgagacatcaggcagcagaaaggaaggtgggatggagcaggccctgtgaaggaccaagaacaaagtaatagccacagttatgaaatttcattttattctgataaagactaatatatgcttgataacctagtgataatccataagtttggtatttcacaacattttttagaaagcacataagattaacattcaaataaggcattatagaaagttttataaagaatgaagtgtttcctataattcttttaaaaaaccttggttcatcttgaaagatcgatgaattttttaaatatcagaagaaaagggaaataaaattttccccccaaaacacataagaaccacttactggcacttgtattttaagtacctgggaaaaaaacggaacagatttttaaagggccataacgac

SEQ ID NO: 858 - DNA, 377 bp, Homo sapiens
tttttaaactgtaaaatgttctttactttttttttttttttttaaaggaacaaatagcgaaggatttgctttcaggggaagaagaggaagagacgcaatcatctgctgacgacctcaccccgtccgtgacctcccacgaggcctccgacctcttccctaaccggagtggatgtaggtgactctgtccccatactccaccgcagccaggccccctgccaggcagtcgtgatgcttgatgaagggtccttgggctgatgcaggccaagaactcatcacagatgagggcgtctgcttggcgggaagcgtcagtagccctgggggtgctttgttctcctccacgctggccagtgagcctggactctcagagcgatttggtt

SEQ ID NO: 859 - DNA, 1880 bp, Homo sapiens
agccgagaggtgtcacccccagcgggcgcgggccggagcacgggcacccagcatgggggtactgctcacacagaggacgctgctcagtctggtccttgcactcctgtttccaagcatggcgagcatggcggctataggcagctgctcgaaagagtaccgcgtgctccttggccagctccagaagcagacagatctcatgcaggacaccagcagactcctggacccctatatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctggagggctgcaggttcctgcatggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtagcctcgagagcaccccttgccggtgaaggatgcggcaggtgctctgtggatgagaggaaccatcgcaggatgacagctcccgggtccccaaacctgttcccctctgctactagccactgagaagtgcactttaagaggtgggagctgggcagacccctctacctcctccaggctgggagacagagtcaggctgttgcgctcccacctcagccccaagttccccaggcccagtggggtggccgggcgggccacgcgggaccgactttccattgattcaggggtctgatgacacaggctgactcatggccgggctgactgcccccctgccttgctccccgaggcctgccggtccttccctctcatgacttgcagggccgttgcccccagacttcctcctttccgtgtttctgaaggggaggtcacagcctgagctggcctcctatgcctcatcatgtcccaaaccagacacctggatgtctgggtgacctcactttaggcagctgtaacagcggcagggtgtcccaggagccctgatccgggggtccagggaatggagctcaggtcccaggccagccccgaagtcgccacgtggcctggggcaggtcactttacctctgtggacctgttttctctttgtgaagctagggagttagaggctgtacaaggcccccactgcctgtcggttgcttggattccctgacgtaaggtggatattaaaaatctgtaaatcaggacaggtggtgcaaatggcgctgggaggtgtacacggaggtctctgtaaaagcagacccacctcccagcgccgggaagcccgtcttgggtcctcgctgctggctgctccccctggtggtggatcctggaattttctcacgcaggagccattgctctcctagagggggtctcagaaactgcgaggccagttccttggagggacatgactaatttatcgatttttatcaatttttatcagttttatatttataagccttatttatgatgtatatttaatgttaatattgtgcaaacttatatttaaaacttgcctggtttctaaaaaaaaaaaaaaaaaa

SEQ ID NO: 860 - DNA, 399 bp, Homo sapiens
tttcagtaaattttttttaatggaaatcttgaaaatatttgtcacagatggggtgaagctaggggcactccatgagtgacactgtccagcaagctttgtcctggctctgcctgggctccttcctccaccctcgtctgccctgcctgtcttccaccgtgggcactgctggtgcgcagaacttgctggacctgtgcaccatgtccacagcttcagaaactccactcccctccagcttcacctgggtgggtgtaaaagtttatcaccttcttctgaagtgttatgttcaggtgacattaaagtgcgtctttttaaccctagaactagtcgcatcatgctgtctcaaaattccatcagatggtcaaagcccagcagggacgattctgaaatgttgagttccta

SEQ ID NO: 861 - DNA, 4040 bp, Homo sapiens
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 862 - DNA, 315 bp, Homo sapiens
tttagtttttaaaacataggcagattttattagatgtgttaagtagtaagtagaacatgtgttagacacagaaaggaatagaaagtccaggatacctaacattcctagctaccaagtatacatgagacacctgagcatgaaatatttgatacattaaatgtccaagaggcactaaatacagtgcataaaatacacataagcatgaaatagtcatgctattcacttctgtccccaagtgtcctctgtccaagaaacacagtaaaacccatggttgctccacaggccaacaggcaaagctcagctctttgccaggct

SEQ ID NO: 863 - DNA, 967 bp, Homo sapiens
ggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaaaaaaaaaaaaaaaaaa

SEQ ID NO: 864 - DNA, 447 bp, Homo sapiens
  misc_feature (43)..(43): n is a, c, g or t.
  misc_feature (338)..(338): n is a, c, g or t.
  misc_feature (426)..(426): n is a, c, g or t.
aactttactcataaaattttatttgaacaaaacaatttttganaatataaaaatttcataagaactgctttcctgttagatacaaaatttattttaaaaataaataattatattgacctttaccatcacttgtctaaattttactcatgtttattgtgaagacacagaggtgaattagaagagtatatcattatacattgtcaaataaagcgaaggtttccttatccaaatagagagaatatatatgtgattacttaatataaagcaaaagctatttctaccaaagaacagacatgcagttattgatctggaattggcatcgattacaaactactctngcaattcttcctctccccaattaaggtgtctctcttgaactggattgaaagctgtttgataagtatacttttttcaagatggtgtgcncagttggggggccttttatta

SEQ ID NO: 865 - DNA, 2069 bp, Homo sapiens
ctatcaatctccagagctttttctttttaagtgtgagcgagtttattagagaagtaaagagacccaagagtgcctactccatagacagagcagccactgtgacactgtacccattaaacactaactctccattgcccctccagcaacccctagcacccactgtctactttctgtctctatgtggttgtctatttgagggacatcacataagtggagtcatatatttgtcctttcatgtctcccttatttcatttagcataacgttttcaagggtttcctgtgttgtgaatatatcagaatttcattctctttttaaggtagaatcatatcattttaaaacatttcagttggaccatctaagttcagtccttcattttcaacaattaaaaaacagccctcaaccgggtgcatctcacgttagctagagacagaactggagctagaagtcagatctcttaccaaagttgcctttcttcttctgtgggtaagtggggcacccttgggacgctgtgctgggcgtacatgggtgcttgatgaagttacttggtggactgatgtgattgatgtccaacatgtatgcagggacagaggctatggtccctacagagcaggcatggagagaaggagaaatacatacgggcaggagccaggagagggagggtgtagtgagcagagaccgcgccactgcactccagcctgagtgacagagtgagaatccatctaaaaaattgcttactaaagaagtggtctcctgaggtcttaagacgttcctggcaatgtcttgagtgggtgggagagagcctccagtcattgagctgtggaatttcagaggtgagaaccacacctaacccccaattactttcccctgtttgcctcagtgacacagctgcaggaaccctggtgggtgttgtattaagtaaatttgacctttattctttgcagatctgtgaaatgttgtcttctgaggggccacgtgtatctgtagtgctgaggactccttggggcctctgaagtcacagagagaacctgcagggtgggggaccagtgtgtgacagccctgctttgcattttctttgagaagtgctgtcattttgcatttctctccaccaggggaatcttcaatcttgagaggtgtgatcataacttgccttgtttcttgtcgctacagagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattgggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacacggttcattcaggcaacgcacaaaacagaaaatgaaggtggaacaagcacatatgttcttcaactgtttttgtctacactctttctcttttcctctacatgctgaaggctgaaagacaggaaagatggtgccatcagcaaatattattcttaattgaaaacttgaaatgtgtatgtttcttactaatttttaaaaatgtattccttgccagggcaggcaaggtcgtcacgcctgtaatcccagcacttcaggaggctgaggtgggcggatc

SEQ ID NO: 866 - DNA, 572 bp, Homo sapiens
  misc_feature (427)..(427): n is a, c, g or t.
  misc_feature (536)..(536): n is a, c, g or t.
  misc_feature (542)..(542): n is a, c, g or t.
  misc_feature (564)..(564): n is a, c, g or t.
  misc_feature (572)..(572): n is a, c, g or t.
cacttttagtcagagggtttttattaggagtaaattttcctaggttctcgataataaaggttaatatatttttttcaaaggcacaacgaagcatcctttcaggtcaccactgatttcaaaacaaaacaaaacaaaacaaaacagaaatttcctgatttgatgtgtaaaaggtcaacatctgctgatgctcagatatggggaatgtggtggaggcggccgaatgggatgtcgagtgagcagtacagttagaggggccatgcaacatacaactgacactccaaacagaaagacaccccaacgccaaagaactacttttccatccatccatttctgaaactttctgacaggccagatcactatagcagcctcaataatctgtgtcagcttgcttctacttgcttccctgttgactaaaatggcacgtgcnaatgcaattgtcaagggcctgaaaggagcacattgtgggggatatataccgttagggcaatgccaagggggatactaaagccgaaaattagactattagagctgaaggntttcanttgcaagttttaacctggtgcnggttccan

SEQ ID NO: 867 - DNA, 358 bp, Homo sapiens
ttttttttttttttttgatggacaaactgcgtcttagtttattcagacagaagaacactgctcacaattaaaaacgaaggaacagacagcaaggagctacggacacacacaacagcacggatgaagctctaagtcataggatgaagaagccagacatcaaaggctccaactgcaggattctgactcctcgaaggtcgtgagccggagaggtcaatccacggtccttaagtcagagccacatatggtgagatgcatgctcttcagtggagacccagcccctagaaggtccctccagcccttcctgtcggcgtccctccccatctgtggctctgacttaagcaccggagaggtcaatcca

SEQ ID NO: 868 - DNA, 6303 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacggaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacacaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacacttaaaacctagaacttcaaaatgttcgtattctattcaaaaggaaaaatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattattttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcaaaataattcttccagtgcaacaaaatcaattttttgctaaacgactccaagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatct

SEQ ID NO: 869 - DNA, 399 bp, Homo sapiens
  misc_feature (200)..(200): n is a, c, g or t.
  misc_feature (227)..(227): n is a, c, g or t.
  misc_feature (277)..(277): n is a, c, g or t.
  misc_feature (335)..(335): n is a, c, g or t.
  misc_feature (346)..(346): n is a, c, g or t.
  misc_feature (372)..(372): n is a, c, g or t.
tctagttttgcttttataaaaatcattatttcgaatttcacagtgaagaggtactaaattcctcatagaacatgaaattatataaaaatagaagacatagacatctttaaatctttaatcctttgattaagcagcaagcatatcactcttccagggccaaacactgcttaaacaaaaaagaaaaataatgacgtgcaaantatttacaaaatatgcaaagcacacantaaagacatctcactatatacatgtgtcatattactaatgaagctaacgnttttctactgtgtgctctaatgcatggtaaatcaaattaccggcacatcccctcaggntaccggcaccntgggccccctgttctggggggtaggnggggggttttttttaatggatccccat

SEQ ID NO: 870 - DNA, 3210 bp, Homo sapiens
gtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgtttcagagtagttcacaacagatctgagtgttttaattaagcatggaatacagaaaacaacaaaaaacttaagctttaatttcatctggaattccacagttttcttagctccctggacccggttgacctgttggtctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaatattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttatagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttcttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataa

SEQ ID NO: 871 - DNA, 3700 bp, Homo sapiens
atacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagatgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctaggggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaaaaaaaaaaaaaaa

SEQ ID NO: 872 - DNA, 400 bp, Homo sapiens
tttacacattttcagacatcatcttgtttattacaaaacttaaaacaccttccaggcaagatccaaagcaattttatcctaacattgttcaccttcatctgtagagtcaaatgtatctgccagcttgtgttgacaagggggaatgcttcccatttggtcaaggttgagggacagtaaaggaatcttgtattctaatgagtacagcatcctttcattgtccaagccatccaccttaggctttgaggttcaagtccaggtctggagaagagaaagtttcatacccaaccttgtggtctttccttcggtagtacattcgtgtcagcacagtcattagaaaagtctccagtatgaggaggtggcaattcatcacttgagacctggttttagaggaatagggagg

SEQ ID NO: 873 - DNA, 456 bp, Homo sapiens
  misc_feature (10)..(10): n is a, c, g or t.
  misc_feature (252)..(252): n is a, c, g or t.
  misc_feature (318)..(318): n is a, c, g or t.
  misc_feature (382)..(382): n is a, c, g or t.
  misc_feature (419)..(419): n is a, c, g or t.
gctggtcttntacttggcagatgcacttcaaattaacctgttaaattaggtcatgttctttgagttttgtttctaattcaaactaatcagaattctttaactaatgcttttgaaaagttatctggccatatgaccttggtaaaaagccacaaatacatttgcttaaaatccaacctcaagtcacaaacgaacaagaaagtaatgacatcagaggatgtaagccagtagtctaatactcagcccaccacggtnttactgggagtcgctgacttttaacatttaattatcaattttttttttgggacagtctcgctctgntcacccggggctgggaggtacagtggggtgtggatctcgggcctcactggcaacctctgcctcnggggggtttaatttaattcttgggcctcgaggggccnaaaatttccctataggtgaggtcggtatttaaattct

SEQ ID NO: 874 - DNA, 220 bp, Homo sapiens
ttttgacaaggaagagagtgtttattcaccatgtcatgttcacaactgctgatgggctgcccaatcaggtttgtgtgggcatcctgatagtagtgccagggtaagtcccagagcaaattttagagatatccaatggatctgaaacagggtgctgtcaggctacacttgtacacagatggctggctcagaaatagccagagcacaaagacaggctgatgga

SEQ ID NO: 875 - DNA, 400 bp, Homo sapiens
ttttttcattttaaacttacagattctgctggcttgcattttattttatactaacttgcctactatccctttaaactgcctgttctctccctcatctctctttaaacgaaaaataatatcctataaaacagagcagacagacagctgtgcactactgcgtaatccatctttctaaaatcctcacacttgacacagaagccaactctcattttagatgcttggaaatagaatcaagagcaaattctagcattctgggtggctaggttgaaagtacacatggcagttctcagaagggtgatggggccagcgtcaagaaatgctctgttcttaccgatcacacccttcatccagatcttgacaatcacacaaacaagtagccacgtggttcttttccccattc

SEQ ID NO: 876 - DNA, 338 bp, Homo sapiens
tttttttatattcacagttgtttttattgggctacaccactgtgaagcatacatgatggatatgtcttctaaatgactatatgaataatacctaatagttacgtagcacctgatagcttacaaaccacatttgcatccattttcgacctaactcttgcaatcattctcaagtaggcattaaattttaaaacatatatctatgaggaaacagatttcaaaggatgaaggtgacttgtcccaaatctcagttattttcattctttattttgttgattctctatgatatcatatgtcatatggcaaattaaagtgaacagatagccacatgtacataatat

SEQ ID NO: 877 - DNA, 874 bp, Homo sapiens
gcggccgcgtcgaccgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtagcagcatccttgggggaagggaaaggtgcatggtccacaatgtatggtttggtcccatgggacatgtcatagccttggtttagttttgggtggagctgaataaacccaaatttcagggcaaaaaaaaaaaaaaaaaagaaaaaaaaaaaaaaaaaaaaaaaaagtcgacgcggccgc

SEQ ID NO: 878 - DNA, 369 bp, Homo sapiens
ttttttattttttttttttttttttttcttcatcacatacattgagcaccaagagggagccaagggtggctgtgcacaggatgtgagcaggggcggtggtctggctccagcaaggcttgggggcatttcacaggtagaaggcagcagtgttgtacctgggcagaaagtcattaagattttgtaggagagggtgatctgctagagaggaatgttgtgttatgggtatatatgcttgaaattaaaaccatatcccagttaaaatacacagctggtgagtcattccacaaacctttagaactctgatgctttaaagccagacttagccatttaataaccacttaggcagttaatagtaaagtaattgtagta

SEQ ID NO: 879 - DNA, 3802 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagtaagacccagaaaacatctttaattggttcttatactgtgaaagggacagggttagggagtcatagctgtctttttctaaagccctgtctccttccaggatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttaaa

SEQ ID NO: 880 - DNA, 492 bp, Homo sapiens
tttcaatggcatgaaagtggtttaataaagtcagtcatgatggaataccaggcagccattacaagtcaagctacagacaaataatgacctcaaaaaatgttcacaaaatagtagtacaccaagacaaaagtgcattttcaatatgatcatctgaaaaatacagtattctctttgcaaaaatgtagatgtacttacaaatgcattgtaaaagtctggaaggatttataccagaatattaatcaatattttcatcttattttaaaatttcctaaatatctgaaatattcttcagagaacctcaattcctttgtaatcagaaaaattagttaaaatattaaaagcaggcaagtaatatcaacaagatgatacactaggagatcccagctcttgtctccccaacaaaagcaagaatttaacagctacttgccaacaaaaatagctctgagaatactccagagtacagtgaagaagctgcaggaacccattaaagca

SEQ ID NO: 881 - DNA, 4580 bp, Homo sapiens
cgggggactgtgccgtgtggaacgtgtagctgttgagaggtggactctgttaccattgaggatgtttggaggatgagtatgtgtggcagaggcacacataaacaggcagagaccctttgcccctgcctttctcccccaacccaaggctgacctgtgttctcccaggtctgggattctaagtgacctgctctgtgtttggtctctctcaggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggcggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccagggatctgccagcccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 882 - DNA, 185 bp, Homo sapiens
  misc_feature (181)..(181): n is a, c, g or t.
acattctgagtttttacttcttaagaagaaatttaattcaataatttgattcatcactactggaaaactacatctttcttccctgtcagtactggatggcaatgacgtgaaagcagctttcctggttctcaacttcccttcaatgggaagcattatggaatttcagcagtgaacatcatcngggt

SEQ ID NO: 883 - DNA, 362 bp, Homo sapiens
  misc_feature (276)..(276): n is a, c, g or t.
  misc_feature (318)..(318): n is a, c, g or t.
  misc_feature (357)..(357): n is a, c, g or t.
agggctcggcgtggcagggatgatggcaggctcagcttgggtgcaggtgtggaagcaaccactgggggccggggcaggacctccagatttggcaccgggaactgcacatccatggcagggctgggctttgctgcctcctttgctgtggctgcgtcgtcctctgggggtgcagggaagggctcacttctccggggtggcgtccgactgatgctgttcttgggctggaagatctcgttgtagtcctcggcgttctggatctccgcgcgggactccgtncggtccccgggtcatcctcgctgctgggggctgcggcgcttngctctctgagttcttgcttcaacctctgaggcttacttncaagg

SEQ ID NO: 884 - DNA, 413 bp, Homo sapiens
  misc_feature (234)..(234): n is a, c, g or t.
  misc_feature (259)..(259): n is a, c, g or t.
  misc_feature (292)..(292): n is a, c, g or t.
  misc_feature (295)..(295): n is a, c, g or t.
  misc_feature (298)..(298): n is a, c, g or t.
  misc_feature (363)..(363): n is a, c, g or t.
  misc_feature (373)..(373): n is a, c, g or t.
  misc_feature (395)..(395): n is a, c, g or t.
tttttttttttttgagcggttctcacattgtaattctcagaggtgaaaactatacagaaattgctggagcagtttgaatctctagaaaacattcacctccccacccactaccccaacccatgcccttgacctccaagaactgagccgagcctggggcacccgcggcctgtgctgcaagggtcaccttgtgacgagggccgtgcacagcctccgggcttagtcagggacaaagantcctgtcccatccatgggccccagntccccgtgagcgggtaagagggcgcccagcagncgnttnccttccatcttagggcgggtttcgggggcccacgggaaaatgccctccacaggttttcccctggnacccacagcnttttgttcccctgcaccaccanggaggcctgaggttttga

SEQ ID NO: 885 - DNA, 519 bp, Homo sapiens
  misc_feature (224)..(224): n is a, c, g or t.
  misc_feature (266)..(266): n is a, c, g or t.
  misc_feature (411)..(411): n is a, c, g or t.
  misc_feature (443)..(443): n is a, c, g or t.
  misc_feature (456)..(456): n is a, c, g or t.
ttttttttttcagagtaaacagcatgtttattttgaacattcaagtttacaaaaacaaaaaggtaacaaaaccatgacacagatcacacacacatacacacacacacacacgcacacacacgcacacatgttgcagctcatgtcaatttatgtacaaaacagggagaggagaaaggggcaaggctggggaggggttgtcagtagggtgcactaatgtcacagtntcagacaacttgacatgctcactcacactcagcctgggcccntgtgagccccttccccacccaggggtcgggggtcagggtgggaggtgggggtctggggtggcaggcagctgggattaaaggggtgaagagagtagtcccttctctgggagggagcccctttccaagtttactcaggccaagggtnttggggacacacaaaggaggggggtttcagtnctggggagaggtngttgcttcctagagagggttgattgcatcagaaggttgggttcaatttccctttccagttggg

SEQ ID NO: 886 - DNA, 512 bp, Homo sapiens
tgtaagaagcattttttatttggatatataacctatgcaagagttagggcaagaaagtgccagggactgcctatgaaaggaagtgcatctataaaccagtgaaaaaaattaaatccatctgcgaacttcaggcactgttttaaaagggacacttaaaaaagcatccacagggcatctcaggaaatgtgctctgtgtacaagcccatcttggcatgaatacagttttactgagtatgacacaacacagttgctctagggaagaagaaagaatatacaccccccacgcaaatatttgataattgcaacaggatgttaaaatggaagttttgctaaaacatcaaaatatactagatgctcgatccaaaagaggtcctggactaaaagcagactctacgatagaggctaacagctggtgaactactctcaacttgtaaccacagtcccactcaactttgcccacatggagcacaaaagggttggattttaggagatggggaaagaagctgtagaga

SEQ ID NO: 887 - DNA, 400 bp, Homo sapiens
gaatctctatcaaatgtcggtttttttattcaacaactgacaagcacttttctacagctgcacttgtggaacatcacatggcaaaaacaggagttttttcgctagactttttttttctttttaaccttattaaaaatgagattggtcctaaaaatatagaaagaaataaatttaaattcacaaaaaactgtacattatcaaaaagtcactaaaacaccacatttggttatataaaaagtcccttttgctgtaaaacggaacacagaaacttgttggtgttgatggtgtggtttcttcctgtcaaccagactgatgggagggaagcaaaagggcagggggtgggttgtctttttattttaaacctgctttccctaccaaatactcttgtcatgaagagaaa

SEQ ID NO: 888 - DNA, 2867 bp, Homo sapiens
tcccgtggagcagaggggcaaagtggcaggaacctcttaaagggcgagacgggcggcgaccgagaacgcggtcggcccggtccccgccgcacccagcccagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacacaaggtgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattatttttagagtcttcttatttctgaagcatgtgaatattatctcgatcgttaaaagtcctgctcaggaagaactcagagaagatccagattctgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccacgaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggggtttttaattgggtggtttgtaaccccttcagcctag

SEQ ID NO: 889 - DNA, 537 bp, Homo sapiens
tttaagtttaacatgtacttttattaacaacttaatacaagactgtacactgtaggtgctgaaatcaacccactcctgaaaactgaaaaaccagcatttctataccactttgggctttggttataagtgccatcttctacagcaaaatcacgtcttaagaacaggaaaaacgttccacgggaatggagagattatctatgcataaacagctggggatcatttctagctttacgtgattcactacacgctctggaatgttcagttcccttttctacagtcctaccacgagacatacagcaactaagaacttggccacaggtcctgcctagacacacatcaatatgaaacaaaaaagatttatataaataagtcaattaaacttcacaaaaactaaagagacacaagatcaaaaatcccacaagcattaaaaactgttcaataattgggccagtcttttaaatctgaaaatgtggaactttaaaagaggtatttatcggattaaaaaagtgctttacatctcggttagctgggggtgaa

SEQ ID NO: 890 - DNA, 390 bp, Homo sapiens
  misc_feature (341)..(341): n is a, c, g or t.
ttttttttttttttttttttttttttttttttttttttttttttttttttaaaccccccccgtttaaagagggggcccaaactggaggggctaaaaaaaggacactggggaaagcccccatgggcccccccacactggttgaaaactgctcaaccgatctgctccggccggagaaatccgggaaaaggcccccagggttgaacaggtaaatggcaatggaggggcccacgaagtaatcctggccctaatccttggggccggcattgtaaaacacccggaaactgggactagcctgggcaacctgtttgggggagccggtcaaacccaacagggatcaaaanccgggttcaaaacccagggccctggggctggccctgcccacctgttttt

SEQ ID NO: 891 - DNA, 1417 bp, Homo sapiens
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgta

SEQ ID NO: 892 - DNA, 356 bp, Homo sapiens
  misc_feature (336)..(336): n is a, c, g or t.
  misc_feature (354)..(354): n is a, c, g or t.
tccaaagtttattttatatagcacacatttatatggaactgtaacagtgtttcaacacaagacatttgtgcagaaaaataacaggaactcttttgttaggatgattgtctctgttttatacatgaaagagctagtatataaaaatagtttttaaaccaaaggtaaccttctctattctatatcaaaagtacaatactctgagtgggcaaagaaccaggggaatctgaaaggaattacctccttttactaatccaagactgggcagcccaaagggaacactgggcctgcttcagactatttacgggttcacactggaaactcattgggggggaattnatctgcatttggattttntg

SEQ ID NO: 893 - DNA, 426 bp, Homo sapiens
  misc_feature (250)..(250): n is a, c, g or t.
  misc_feature (256)..(256): n is a, c, g or t.
  misc_feature (258)..(258): n is a, c, g or t.
  misc_feature (261)..(261): n is a, c, g or t.
  misc_feature (267)..(267): n is a, c, g or t.
  misc_feature (286)..(286): n is a, c, g or t.
  misc_feature (418)..(418): n is a, c, g or t.
ttaactttatcacatagttttattgaccacaaaagaagacaaatattaaaacacattatagatattagggttaaaaagaccagtggtacctccttgccgatacaacattgacccatattgcatatttttcttccagactagtttaaagtgactcaggtatttggtctgtattattttttccatggagacaacttcagaatctaatacaactttctgtgttcctgctgcacctgaatttatgtctgaaatnggcttncnatncatttngacatattttttagtgcanggattttaacctactaaaaataatggaacctcatctatttaaaactatattatgtgtttacaaagctatattaactaaaaaatttccttgtggtttgtggtagcttatctccaagggggcccaccatcaatncctggcct

SEQ ID NO: 894 - DNA, 406 bp, Homo sapiens
ttttttttttttttttttttttttttacagacttcaataccccacttttaattatttatagaatgaataggcagaagatccacacagaaataaaaacttaaataaacttagatttaaccagcatctacagaacacttcaccaaaaacagcagaatacatattctcaagtacacataaaacattctccacgactgacaatatggggcatacaccataaaataaactcgaatacctttaaataggattgaaatcataaagtatattgtctgagcacaatagacttaaattaaaaatcagtaataggaagaaacttgggaaattcacaaatatgtgaaaattaaacaatacactcctaaataactaatggatgaaagaagaaattcaggggaaattagaaaaaaacttg

SEQ ID NO: 895 - DNA, 429 bp, Homo sapiens
  misc_feature (297)..(297): n is a, c, g or t.
  misc_feature (323)..(323): n is a, c, g or t.
  misc_feature (330)..(330): n is a, c, g or t.
  misc_feature (341)..(341): n is a, c, g or t.
  misc_feature (357)..(357): n is a, c, g or t.
  misc_feature (367)..(367): n is a, c, g or t.
  misc_feature (419)..(419): n is a, c, g or t.
aaaaccatatattttattgatgttcttcaaggacaatacagggccatgtgtacaaatgctactcaagtctcacatctggcaacctccccaccgtcatcccccattgaccagtctgcaagcagccaacatcctgtaggtctccctgttgcccttccccaggatgtcaggcctcaccgtgctgagccttcaggaggctggaaatagcagggctggcttctaagcttgagctctggagccaggaaagagtcaaggccaaaattgcccagatcttcccctcctccctctccctcccattgnttaagtatggccagaatttgtgggtngaaaatngccccagcgantcctccatttgagggnagcctaaggntttccccctctttcagggcatctctaatcacaattcttttaatttcccaatngaccttgggc

SEQ ID NO: 896 - DNA, 2753 bp, Homo sapiens
agaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaaaaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagaggaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttg

SEQ ID NO: 897 - DNA, 1291 bp, Homo sapiens
ctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtctcaaaaaaaaaa

SEQ ID NO: 898 - DNA, 1047 bp, Homo sapiens
cgaattcccctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataaatataaaaaaaaaaaa

SEQ ID NO: 899 - DNA, 1984 bp, Homo sapiens
ggatccagagatttagattttttataagctttcctgccaccgaaacgggtgtttgggacctcacgaggccctgttcattcttcgtcgctgcgctccccactctgtactggatgcatttactgacgttgttgtctccgtccccagagtatgaacccccaaggtgactcatgcagctgtgggtgcccggcatacagcatggtgactggaatggatgagcacccaataaacatttgttgcaggaatgcaggaggacgggcaggccagcaagcaggctgcctggtttttcccacatgggcttttctgggaaagaagagcttctatttttggaaagggctgctatgattgagaaaagttcatggcagcaaaaaaaggacagacgtcgggagggaaacactcctagttctcccagacaacacattttttaaaaagactccttcatctctttaataataacggtaacgacaatgacaatgatgattacttatgagtgcggctagtgccagccactgtgttgtcactgggcgagtaatgatctcattggatcttcacggtgggcgtgcggggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcacgctccacgccgcctgccaggtgcagccgtcggccacgctggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccttccactctgaggtctcaccttcgcctctgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcggcaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 900 - DNA, 276 bp, Homo sapiens
tttttttttttttttagcacgagcccatttttataattaaaaaaaagggtgtacacttataaaagcagcagaaatatttggaaggaaaccatgcccctgctctgaaagaacaggacggtagagcaagaagaaaatgaagcaggctgggactccctgagcagcgcagtgagtagccagcctgccgcccatcagtgggaggtggcaggagagggacgggtgagcagggcccactgcctatgagcagggcactggccccagccggggctggggaggagc

SEQ ID NO: 901 - DNA, 247 bp, Homo sapiens
  misc_feature (238)..(238): n is a, c, g or t.
tccaggacattgtcataattttttattatgtatcaaattgtcttcaatataagttacaacttgattaaagttgatagacatttgtatctatttaaagacaaaaaaattcttttatgtacaatatcttgtctagagtctagcaaatatagtacctttcattgcaggatttctgcttaatataacaagcaaaaacaaacaactgaaaaaatataaaccaaagcaaaccaaaccccccgcngaactacta

SEQ ID NO: 902 - DNA, 526 bp, Homo sapiens
ttttattctttcttgaggcttcattttgttcaaggtcactaccttgtgatgctttagacttttgggtaggatgaataatgtgtttttctttgttgtaggaaggatccgaagataaagcttcagaagatggtatactaacatttttaggatctgctgatgaagcaatggtctttaagtttatcatagaagtaacatttttaggggctgctgacagttctgtagataatgtctgtcgaacaacataacccattggtgtccaagataactctcttgtacatgaaggagaattggtagcggcattagcagttacagattcatttgggttatttttcaccactatttcaccctttgataacactgcagctggttttactacttctcttagaagagaaatgtcggtagagacagagtggacaggtccccacttgggttgcttctgtatctctgacatattgttctctgcaccttgcagttcaggaaagtccagtgtggtaaattcaaactcaggtttggaggtagatacatt

SEQ ID NO: 903 - DNA, 447 bp, Homo sapiens
tggcattaggggaatttaatggcatgatcaggtggcaaggtccagagatgattacttagggtgggagaatgttacaggggtcctgggacacagggcatccagggtgggaatcagagggagaggtaggtggccagtttcaccctctcagcgttgctggggctgagccctgcaggagcaacctgtgtgctggagggagagcctgcacatgcaggctggactctggtggcccacggagaaggtcagcaatctctgtttctcttctccggttcttgactttgcaccaggcagctgtggattatctcatcaaatagagcacaaggctcaggaggctgagccatggagttgctgctcttagcttagccccattgcagcttttagcttcccccagagcaaagcactgttcctaaggctgcaggccacagccccagaaaacaggtgcctcgtgcc

SEQ ID NO: 904 - DNA, 341 bp, Homo sapiens
ttttttttttttttttttttttttttttttttttttttttttttttagagccaattgatttaagggaataagacacagtcattgaaaggctaaaaaaaacaatagcaacacaaaaaccacttgggagggaacattaaggggagcagcgggctaggccttttgggataatatcccgccctgaattctttaacactactggtaatttagggtcaaacggggttctggtctgaccataaaggtttctacattggatgaaaaagggtggctcaaacccaaagggaatttcttaatagcaaatctcatttattactaatcatttctttaatttagcatacccattt

SEQ ID NO: 905 - DNA, 502 bp, Homo sapiens
caaagtagacttggagaatgtgaatctacctgttgcaatgaacccgtaatttaagtgggacttggtattttcttttaaatgcagcgttccttttgttgatagtcttagattcttctgctgtctcatcattgggtcttttgcccttttcaaaggagctctctagtgatgtttgttttttactcattttggctatggttagcttgtgggtttaccaaaactatgactgagacaagtactcagtgcaggaaagagacacggatggaagtggtaaataaaaaaatgggcaggccacatgcagactaaaataagtgtcagattctgacttaaagcctgccactagatgcaactgtacaattgaagcacatcaactcacttgccactataaagcctactaccagatgcaacttaattttcacttgccactcagcaatagggttttgatatgagtctgcaagcaattgatttattaaggtctctgtgcagtcaacctctctgctaatgt

SEQ ID NO: 906 - DNA, 2387 bp, Homo sapiens
cagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgacgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaa

SEQ ID NO: 907 - DNA, 816 bp, Homo sapiens
atgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgagactctgaggattcctgttcctgtacataaaaatcaccaactgtgcactgaagaaatctttcagggaataggcacactggagagtcaaactgtgcaagggggtactgtggaaagactattcaaaaacttgtccttaataaagaaatacattgacggccaaaaaaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcagtataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttc

SEQ ID NO: 908 - DNA, 3119 bp, Homo sapiens
cgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaaaaaaaaaaaa

SEQ ID NO: 909 - DNA, 467 bp, Homo sapiens
tttccaagagaacatagatttatttggaacccagagttgctcgactgaaggcacattgggatcacccccagagatggcatgaaaggggcgagagagtggggatggccacagcaggaacgtggcacggagatgacagggctgatgacgggaagctcaggaaggggcagtgtgaagggagggaggaaactcgggaggctgtggggtcctcctgacgtaaactctccagtcatcttctttctttttatttaacctgggatgtgtattaaacgtgtagactcctgggcatcgtcagaaaatctgggagcgggacttggagatctatgtcttaacgtgctcttgggtgattttttgtaatgcaagttaatgagagcatggggactgcatctaccttgttcacatgtgtatcccagaaacctagcctagtccggggcagggttgaggaactcagtatatcttgatgggtgaat

SEQ ID NO: 910 - DNA, 394 bp, Homo sapiens
  misc_feature (6)..(6): n is a, c, g or t.
  misc_feature (9)..(9): n is a, c, g or t.
  misc_feature (331)..(331): n is a, c, g or t.
  misc_feature (356)..(356): n is a, c, g or t.
ttcagnttntctgagttcttttaattacctgtatcagatgagtaaaaagacactccggacataatgaatgctttcttaacacaacagaaccacctacacacatgaacaggactgttcagggagcctggtttggtgtgaactggggctggctcccagggtggagcctgctcttagaacacaccagaaggctggaaggctctagtggggccgcttgcacacgcaacagtacagttttacttttttcctgggggcagtgcagacagtgccatcagctcttagcctttgcagggaggggcacagtcattctttcagactttgcactcctgggggntcttgggtgcttgcatcctgggggnaagggaccgcgcttcgttgggaccagcagggtaggggc

SEQ ID NO: 911 - DNA, 373 bp, Homo sapiens
agggtttgtggcacataatttgtttaatccagattggatacatcaggtacagcagtggcacacgactcaatactgtaaatgatatacatgttttaacatatgcactacagtttcaaaagaagacgacaggaaactcaagggtgttttttttttttcatagaaagttttcatgttttatcttcctgcagttttgtacagtatatttcttctttgccattgtgatgttgataagcaaagcccatttattatacgaaaatagaaaagaacacacttgatgtatctcacgatgacattaatggggggaagggtgtgacctctaaggaaaacattacattggaatgtctggattatccaaaaattataccatcccctc

SEQ ID NO: 912 - DNA, 222 bp, Homo sapiens
  misc_feature (46)..(46): n is a, c, g or t.
ttttttttttttttttgcaggaaattgcaattttatttatgtttgnattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactat

SEQ ID NO: 913 - DNA, 428 bp, Homo sapiens
ccaactgacaaaagatatatattaaccaaaggtagcatggaaggaaccatacatgatacacaaagtgtgaaaatgagctgaatttatgctctggggctgatattcaaggactgagttctgcttctaaaatgcctttcttaggtagcaagtaacagacaagagtttgagcctcgtggaccactggcagtcaaaaatagtttggcccaagggggaatatatgtgctcttggagtggaaaggcagagaccagtgagcctacagcaccatgcgctgctgagaaagaaggggcctcggtggcatagaacagccacgtgggatatggctactcctgcataccagagtctgccaagaacaagcccttctgctgtggacatttatgtttcttttgaacatcactgatacttaactgtttacttttgaggactccgc

SEQ ID NO: 914 - DNA, 400 bp, Homo sapiens
cagtggtttaaaaatcttttattgtttctccaaatgacaatacaagtaccaaaaaccaacatgacacacaggaaaaaataaaagtgcaattttaatatagtgaatgtgatacatgtataattcctcataacaaaatggtcaaaacctttaaaagatccacaatagatatctgaaaatcttagcaatgctgtatatattttgaggactaaatgatgaatttatattcaaattgttcaaatatattttcaaaactttcagagcacagatcattgttaattttgcttttatttaaaaaaccaagagaatacatttctatgtaaattagcaatcaggaatttatctgtttttgggcttcttcatctatctaaagtgtatatttagtgaccagaattatagtcat

SEQ ID NO: 915 - DNA, 390 bp, Homo sapiens
tttttttttacacagagatctcactcctttattagggtgaagattttacagccaatcatcatagttatctttcaagaaaataatcactgaataatgaatcatcttggtattccccaaagcgatgcttatacaaaggcaagacataaaaaatctaggacttaaaatgttaaccacttgtggagtaaactgaatgcaccatattatagtgggtatttccaatttggcacaacacaaattttagacaagttttgacagaaactattaaagaaaattaataatcagttaaaagctaattatttttatactgaaaagttctaactttgagagaaagtgatgagcaacagtcagcaaagaatttactcatcatctagctcagcttcaggacacatt

SEQ ID NO: 916 - DNA, 361 bp, Homo sapiens
ttttgatgtttaacctcattagtatgtaaagtttattacataatatctgacactaagtgttcaatagtgtcagctatgatttttgtagaaagtgctcaataagttatcatcatcatcactaatatcatgaacgctgttctttgatgcttttctcttccctccatccatcttcatcatggcaattccacatggtctgtattcactcctctcttctcttcctaataaaatttctcctttagcaagagcacccatcgcaatagcatcaagacactgctctgcccgtcattcccctttgttaactcatgctatggtagtatgccactgttaaattattgatgatgaattggttgatcccccttga

SEQ ID NO: 917 - DNA, 542 bp, Homo sapiens
  misc_feature (528)..(528): n is a, c, g or t.
aggaaatcaaatatttttattagcccttaacataagaaaaacccaaatggcaaataaatacatgaaaatgaacatactgtccaccagattggctaattggagaaggtatgcataaatgagctcccatatattgctggtaaaaaccactatggaaaactttggcattagttagtgcaactgacaatatacatattcctatatccagccattctaaatcttaaacataaatagacaagttgacagcagtatattcataaaaagaaatacaaggagaaaagatacctttatatggaaaaaacattggtaaaaacattaaagaatcagacaaaaggatatgtaacatacgtttctgtttatagttcccaaacaggcaagattattatattttgtttagggatgtatacataactgttaaagtataaagcaaagcaaagacatcattgcccacaaagttaaaataatggtcagctttgggaagggagggcgagggatatcagtgatttggtaagcagggaacttactaagttntacaaatgttctgt

SEQ ID NO: 918 - DNA, 336 bp, Homo sapiens
  misc_feature (33)..(33): n is a, c, g or t.
  misc_feature (36)..(36): n is a, c, g or t.
  misc_feature (335)..(335): n is a, c, g or t.
cagaatcttgctccaggatcaagtgcagtggcnaantcatagctcagtgtaaccctgaactcccgggcttaagtgatcctcccacctcagccacctgagtagctgggactaaaggtgtgtgccaccatacccagctaagattcatttttatagtctaattattttatattagtttttaacacaattgcagattttgcatgtttattctaaacaacaatttgccagttactggaggataagactgttaaactgggcaattttctatataaaaggttactatattaggaatgggcagcaacagccagaggatttgggggataccaatctttaaatgnc

SEQ ID NO: 919 - DNA, 405 bp, Homo sapiens
  misc_feature (8)..(8): n is a, c, g or t.
  misc_feature (384)..(384): n is a, c, g or t.
  misc_feature (399)..(399): n is a, c, g or t.
ttcaaganatgaaggtagttttaaatttcttcatcaggctgtcagtgttcactggctaagttcggacgtctatccaggcttttttctaatataatgccattagttacagcctgggaagccaggtaactaaactaattagaattacaggtaaattaataaggacttcctgagtaagcactagaggccctcctataagaaataccatacattgtttgccgtcgattttggctgctgaggatgatttagcttcccactgccttttctctctagtaccccaagatgtttttttcaatgagctaaggccgctctacaactctaagttaactccagacaagtcagggtgttgccatctacagtggatttctagctgggatctgactccgncacttcatttacggngtaaaa

SEQ ID NO: 920 - DNA, 396 bp, Homo sapiens
  misc_feature (360)..(360): n is a, c, g or t.
ttttttttgaatgagtataaaactgttcaaataaaattttatttgcaaaaccaggcagcaggctagagttggccatagtttgcagacccctgtcttaggctgtaaattctgttgcatgtgacagagacccaaaataatggtggcttaaataagatagaagtttctttcttagatagcaatatggaagtgggctggtatggtggctgtgctccttgaaattgacgagagacccagggctcctatcttgttgctctgtcttcccacgtgttgctcttatccttatgggtctgaggatgggctgggataccatttccgtattacagttagggaaggtgggaaaaaaggtatgttccctttctnttctttttttttaaacagtctcactctgtcacccgg

SEQ ID NO: 921 - DNA, 475 bp, Homo sapiens
  misc_feature (444)..(444): n is a, c, g or t.
  misc_feature (453)..(453): n is a, c, g or t.
ttttttttttttataatttaattttcataacagtatttttatttgtgaaatttttttacaatttgctttttttttggtatgttctacatttttttccatgtactaagtatcgtgggaagttccaacctcatacttatgctgcttttctacttgctaatattggatgcttcttgccaggctccttaaattgtgctgtaacctgggaagaaaccttcctactctccacaaaccctgaataatcctgagagtttaaacctcacctaattattctctatcatttagaaactagaggggtggaggactgagagagggacagtataaaattcgaaaccagtgatgcattggctgaaaaacactgacatgaattgtgagagcaaagaaaccacagctggttttgcaggtgcagtccaggtgggccttggcagctgatgttgaattgtacgnttgtagccntatattttctgggctacagctg

SEQ ID NO: 922 - DNA, 507 bp, Homo sapiens
ttttaaggtatgaaataggtggattattgctttcctgattatctaccataaacttctaattatatacatccacctgtctcagacaaatttttaggtgctatatatgctcgcattttcttaataacgaagttcaattatgttcctcttctctccagcattgatttcactcactatacttagaaggtacattttaacaagttaattgtttcattatgcatctgtttgcatttttgtagttttttatagtttatgagatgcacttcaataaactctcacaattttgcaggaatagaaagagggttatttttagcttcctcatcatgaggatactgaagcttaacttatttgctgaagtcatatataatatacagaggcctttcccccagtgtcctggatattattctagtgttctttgctctgcttacgtcctttgctcatttcaaagttaatgagattgtggggtcaggaagaaaggagcagttccccaatacatgcctgaaataaagt

SEQ ID NO: 923 - DNA, 3516 bp, Homo sapiens
cagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccctgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgt

SEQ ID NO: 924 - DNA, 364 bp, Homo sapiens
  misc_feature (1)..(1): n is a, c, g or t.
  misc_feature (360)..(360): n is a, c, g or t.
nattattgattatcttttgttttgtctcttcaagaactcttttcctacacctgaggctttaaaagatactgatggccaggactcactcagaccaattaaatcaggattatgggcatttttaaaaaaagcttctcaggtgatcctaaagtataactagatttgagaaccagaagactcagactgtgagcttcttgagggtagaaattgtgactgcttgtttatacagctcaggactcaatgctgggacaccgtggtgcttcataatcaccggggtgatttttgatgaatttaattcatctctccaaggatcatctcaaattccatgttttctagggatccttcacattattacccataggnctta

SEQ ID NO: 925 - DNA, 474 bp, Homo sapiens
  misc_feature (462)..(462): n is a, c, g or t.
tttttttttttttaagagtaaacggtgtttattttttgttgatttttttcaatcaaatggaattgcttaattaaaaaaaacttatctcttttctccttaaatactacagacaacctcattttatcgcagcagacacctaggaacaaaacactggacccaccagagaaaactgggcaataaaagcatcagaagttcaagtcaactatggaagaattactgttagctggcagctttcaattctaaacagaagtgtcccaaacctattgggtttgacaaaagtttcttagaactggggagctgggaatgttggactccttttaattctattccaatcatttcctgtatagggaaattaaagtcaatgcatcaaataaagacccaaaggaaacatttaaaaacttgtttgactagtattcagtatgtggaggttatttaagtaataacttgttccacccagttaancctgtccggggt

SEQ ID NO: 926 - DNA, 408 bp, Homo sapiens
  misc_feature (264)..(264): n is a, c, g or t.
cactacaaagtcctttattaacaagtcaataaaaacagaagagagagagatgtcaaaatactttccttggaggccccaggagggagaggcactgtcaggactcacctggccagggaaggcaaccccaccaaaggcagaacggaggtcaaggggcagctggcccaggaagcctttggggaatggctcaggcctcaggcagggactgtgcaaacgccgaggctgcgcagggagtgatgggttgggggcttaagccccgagcaccgngttcccctgcatgggcagacacgcagtcaggctagcacctgcccactccacctgtgagtgtacacaggtgtccgcgtaaaagccggtgcctgcacgcagcttacatacagagagcggaacgagggtccccagcagaacaggggg

SEQ ID NO: 927 - DNA, 388 bp, Homo sapiens
gttttattttttatttaattatatccatagaatccactggcttcggagtcataggcctgggttcaagtcctggcttcactggtaacttgctctgtgacctttgataggtcatgtccgcactctgggcctgagcttctttgtctgcaacgacactggctagctggctggtctctaagcatccttccagcgctggatccaggctagtctaaggtggattggccctttaagagccgaaaaagggggaggagccgaggttctttaaaaacaaaaggggatggggcgtttctgggaggggagagaccgggaggggagcctggagattcgggcagagtctccctggcctggaggaaaccctcaagggtcttaaggcgtgaccctgcagccggga

SEQ ID NO: 928 - DNA, 1491 bp, Homo sapiens
cgagactccatctcaaaaacaaaacaaataaacgaacaaaaaaacccacaacgtattattttcttgtttacgaggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaagcatccaagaagggaaagctgggggctccccactgcacttgccacctgagtcacattttcagaagcctctggaaagtcgtgcacagcccaggagtgttgagcaatttcggtttcctctgaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggtgggtctgggtctcttgctgttgctgatgggggccgggctggccgtccaaggctggttcctcctgcagctgcactggcgtctaggagagatggtcacccgcctgcctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctcaaaaaaaaaaaaaaaaa

SEQ ID NO: 929 - DNA, 2334 bp, Homo sapiens
ggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 930 - DNA, 849 bp, Homo sapiens
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctcc

SEQ ID NO: 931 - DNA, 415 bp, Homo sapiens
ttttttttttttttaaatttaacaatatatttatttaacccaatatatccaaaattattttaacatgcaaccaaaataagaaaattattaacgaggggacaaaacacaatacacactacaagaaatcttacccagcatggtaacacgaaatgtagtcttgccaacactacaagggatatttaacagaaaaatattttatactatttctgttttaaaatttaaatcaaaatttaacgaaattaaaaattcagttccttggttgcatgagccaaatttcaagcgtgagggacagtgcagtataaacctacaatgtggtcctccacactccttaggggtgactttgacggaaccaaactcttcggttttgcaaattacctcctaaagatacactgaaatcaatgggaaaattcaccct

SEQ ID NO: 932 - DNA, 173 bp, Homo sapiens
tttttccctcccagaaatacttttattaaaataaactgagcaaggccaggcggctcaaaatgatccacacaagggggttcaaagataatccaacgatggagacaggagacagggtgggagggaagcgggtcacgaatgcacaggaaacagcgggactgtgggaggacaccctg

SEQ ID NO: 933 - DNA, 456 bp, Homo sapiens
ttttttttttgatattaaatgttaaattttatttcaaaaactatcacagcctaaagggaaatataatttaagcattaagatagtacatttcagaaaataagctagtattttcatgttacattttaggtacctatcatttgtcattccaagagatccttgcgttctagactctagaattaaatggggtaaagggttatgcttttaagaactataagctgaaatgatttacttcagttcaatatagaatatttgtcagtcaagataacaatcaatgtgtacaaaaatttacataacaagaggaaaaataggcagtgcagcacctttagaaaaataattaaaagtttcattgcatttacaggtaagtgccacactgagaatttacaatacagtaatttactgcaatcacaggggagttccataaagaaacaaagctcttacactccaggtttttgggaa

SEQ ID NO: 934 - DNA, 469 bp, Homo sapiens
  misc_feature (377)..(377): n is a, c, g or t.
  misc_feature (466)..(466): n is a, c, g or t.
tttttttttattgaagccaatttttattagttatacatcactaccttgttttatattttttcctaatgttaaagggtcagttcattcttttcaactccaaatattttacagaaaataaatgggaaaaaaaccagagtatttatataaatgatcctcataaggataagcctttacatttaaaactttagtcaacaataataactacacataaaggttgataagaatatcttgctactaagaggataatctgccactagaattaaaaaaattcatacttcctaggaaacatcaattcaatcaggtgatcctacacaaaggagttagggatatacccaggttccattaattcttgttcttaggggttttccattaaattnatttatccccagggcaatgggccatcctggcttgggccttttaaagggccttctgggggagggaggggccccttttaatatcctccccntcc

SEQ ID NO: 935 - DNA, 2077 bp, Homo sapiens
cggacgcgtgggcgcgccgcccgcccgccgccgctggagctagagatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctgaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctaccccttccctcagacaggggctgggtggggaggctctttaggctcaggagaagcattttaaagaaacccccaccctgccgcccgcattataaacacaggagaataatcaatagaataaaagtgaccgactgtcaaaaaaaaaaaaaaa

SEQ ID NO: 936 - DNA, 430 bp, Homo sapiens
tttgctttctcaacttttaattagagcaaaggtgagattatgtattgtagggaatatggaaaggcaaaagtatatttacgtaaggatataatctttgaagaaacagtttgcttagcgcacttttataatatatcaaaaatttcaaagcagagattttaaataatgacgttgtacagaatctaaacagtttgtaacatttatcatactttggcagcacgagaccttccccttcagcagatattagcatttttacagcaggagggccaatgtcttgtttccatatcaataattgttttatattttcaaagcatttcacaagatgaggctgtacagactcaggatttctgctatcagctagaatatcaagaagctcggcattgctaagaatgtaagatcttgggaaaattaatcttttaacttcaaggtaatc

SEQ ID NO: 937 - DNA, 1362 bp, Homo sapiens
cctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaaa

SEQ ID NO: 938 - DNA, 641 bp, Homo sapiens
  misc_feature (554)..(554): n is a, c, g or t.
  misc_feature (614)..(614): n is a, c, g or t.
aagcatgaaggtgttcaatatattaatcctgtaatctaaaatattatttgggcaatattcttaatctcttaaatattgattaaatggattttacaggaacaaggtaataaaatcatttttgagcagcgatttcatagttgtgaatgaaaatatgatgcattataaagtgcaagtgactccagcatcttcagaatgtgaacaggctcttgtcccccattgccgaattttacattcttcaatagatgattctctcccaaaacaaaacacttcattcagccatattggaccagtaccttgtccaaagtgagctgccttgtgcacggcttgaacacctgggtatcccaagctcctacagacgacctgtccaacgcgcacttcccagcgatcgtcacaaattgtaccccactggccgctgtggagtatctccactctcccctcgtgagggccgctcccaccgaccagtcgaactttcgtaaatggagttaatgtgtttccactccccttttcccctttctggccttttggtccagaatttcctggccttccggcatatncctggagtcctcgacttccaggaaagccaattgcttcccgatcacctttaggaccccgangacctattggacctggaaatctcgtgg

SEQ ID NO: 939 - DNA, 438 bp, Homo sapiens
  misc_feature (394)..(394): n is a, c, g or t.
attaatagacttatgtggttatctgcatgagaaatgaagtgcttatgttaacattttctgaattgggaggggatggttgctgttcccctccatgggcctttgtctctaagagatgagcacttccttagtaccgctcccgctgatgtttccctgggggcccaggatggatacagccttaggttccgtgtcctgttgcttgtactgatggccgcaactaatgacggatggccacctctcccgccctagtctgtttcattcctttggcttcagggaggggaagagttgccttcttcgcaactccttgtacgtaggaacaagaagccaaagtagtgggcccaggagggaggagagccaggcttctggagacgggaaccaggccttctgaacccacggnggctccacagctgttgcttctgaatgctcaggcatctgatctgc

SEQ ID NO: 940 - DNA, 375 bp, Homo sapiens
ttatgttctttaatccaaacagtttaattcaagcaatctggaatataaaaagcactttctgatattagaaggagatcagactcccaaaaaagatcagcattctttagtcaagcaaaacttggaagtttacaaacagctaaatcagaagcttgaaattcaggtcctctccagtacctgctacattatatgtaattccaaacatgacttcagagattaaagaagaaagggaagatgtttcccattcttttgtaccctatataaactaagggtaccctgccctaatcttttttccaacacttccccaaataacccttccttacaaagaaagaagtctaagagaactctctcatctaaatatatttaagtagaggcaag

SEQ ID NO: 941 - DNA, 346 bp, Homo sapiens
ttttatttcatttaatgtttaattcagatctagtacagtgatggggaggagggtggtttggggtggtgaggagtggtggtaaggggaccctctggcatcctcagcatgtagaataggagacttgggagagaaatggaaagttcaggctgggcgcggtggctcacgcctgtaatcccagcactttgggaggctgaggcgggcggatcgcgaggtcaacagattgagaccatcctggccaacatggtgaaaccccgtctgtacttaaatgcagtatctgattaatgttgtaagtgacattgcatatcagcctcagagtcttggttcaactgttggcaaagattgggca

SEQ ID NO: 942 - DNA, 2621 bp, Homo sapiens
cagtgtttggtgttgcaagcaggatccaaaggagacctatagtgactcccaggagctcttagtgaccaagtgaaggtacctgtggggctcattgtgcccattgctctttcactgctttcaactggtagttgtgggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaatgtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgagga

SEQ ID NO: 943 - DNA, 1538 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctg

SEQ ID NO: 944 - DNA, 365 bp, Homo sapiens
tttttttttttttttttttttttttttttttttttttttttttttttttttttttttttttttttttttttttttttttttttttttttttttttttttcgggcccccgggggggcccccggggggggcccgggggggaaaaaaaacccggaaaaacccgccccggccccccccggttttttggaaaaaactggttaaaaggggccccaaaaaaggcccaaggggcaaagggggtccccggggaaaaaaggaacccccccccccccccaaaaaaaaagccgggggggggaacgccccccggggttttaaagggggaaaaaaaaagggggggggggccccccggggaatgggggggttaaaaaaaa

SEQ ID NO: 945 - DNA, 2460 bp, Homo sapiens
ggccagctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagccctgtgctccggccaggtcttcacccagaggtctggggagctcagcagccctgaatacccacggccgtatcccaaactctccagttgcacttacagcatcagcctggaggaggggttcagtgtcattctggactttgtggagtccttcgatgtggagacacaccctgaaaccctgtgtccctacgactttctcaagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacagcgcagccttgcccttatccgatggcgccacctaatggccacgtttcacctgtgcaagccaaatacatcctgaaagacagcttctccatcttttgcgagactggctatgagcttctgcaaggtcacttgcccctgaaatcctttactgcagtttgtcagaaagatggatcttgggaccggccaatgcccgcgtgcagcattgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatccgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattgaaaaaaaaaaaaaaaaa

SEQ ID NO: 946 - DNA, 360 bp, Homo sapiens
tttttttttttttttttttttttttttttttttttttttttttttttttttttttttttttttttggggggggggccccaaccggggttaaagaaaaagggggggaccccagggccggagggaggaaaaaaaaaaaaagctttgggggccccccccttttaaggaaaaaaccccccccccccaccccaaaaaaaaggggaaaaagggcccgggaaaacccccaaacccccgggggggcggggcccaaaaataccagggaaagggggggggggccaaaaaaaaaaaaaaccggggggggcccaacccccccccggggaaaaaatccccccctgaaaaaggggggccctgtgggaacccccc

SEQ ID NO: 947 - DNA, 430 bp, Homo sapiens
ttaaataaataagctgtattatctgtacaaaaaatacaaatacagttttgtgttttagaggagaaagtgcctccttccacattagccagcagccttcattgtcttgtggtgctgctgagttgcaattcacagaacaaacattaaatgtacattcatttcatgcaacgagcattctgcttcccacccaaacctaggttctgccagctcactgagacccactgccaactgctccaacccaacatggagctggaggatgcttgctctttaggaaatgtaaatagtgaccactgattttcaatcactatcgaactagaaataattaaccacattagtagtagtatggaatttgtctgtctttatcattccatgcataactattatgccacaaatgaattccctcttactgcctcagcatcccatgttagttttt

SEQ ID NO: 948 - DNA, 418 bp, Homo sapiens
  misc_feature (348)..(348): n is a, c, g or t.
  misc_feature (374)..(374): n is a, c, g or t.
  misc_feature (380)..(380): n is a, c, g or t.
  misc_feature (399)..(399): n is a, c, g or t.
  misc_feature (404)..(404): n is a, c, g or t.
ttttttttgcatgtaacttttttattgaggcacaacaaggcattgtaacttgcctggacttgaggcagtcagtttagtaagctgaacgttaatacagttaaggattaagtgcaaacaatatacattcacagcttgactagcgaggctacatcacaatttataaagtgccagattagtgctaattgtcattcagcttgatttttcacctcagggaagggaaaacaaaaaagtaagggacctcctccctctagggaacaaaaacattttcctaaaccaatcagtcatgaggggcaaaggactacttttccttccaatcccactaattaggaacaccatccttttattgtncaatactgttactggactttccaatncttggntaaggagggttgggcctgnaaacntggggttttttccc

SEQ ID NO: 949 - DNA, 272 bp, Homo sapiens
  misc_feature (245)..(245): n is a, c, g or t.
atgccacaaaaaacgcactttaattatagttaggcacatcagaggcggggggtgggggcgaggcggcggcgacctcggaaaattcacaacccaacttttgtgttgaaagaaaagaaaaacagaggaaaagaaggagaggaaagacggagagtgagacggagcgagggagacgggtatagcagacggagggagggaaaccctcgcctcaccaccccttctgtcgcaccccacctccgcctagattnttcttaaaggggtagacgccgtctaga

SEQ ID NO: 950 - DNA, 432 bp, Homo sapiens
  misc_feature (205)..(205): n is a, c, g or t.
  misc_feature (232)..(232): n is a, c, g or t.
  misc_feature (402)..(402): n is a, c, g or t.
  misc_feature (408)..(408): n is a, c, g or t.
  misc_feature (413)..(413): n is a, c, g or t.
aaaccattaaggcaaaactgtaccctgaaattaactctgtacattcatcagtcttacagtaggacatcccaaacacagaagttcccatatattcaggatataaatcaatacatgtggtcagttcagtctcctaataggaaaacgaagacccaagatttttttttaaaattaaggttattttatagccattttctaattgcctggnaccaatcagttcatgtgactagaaaanttactttcgctcttctctgcacatccttgattccggagtcctgggatgcccgctccccccaccagggagagaggtatgaagttggagagagggatgctggggcctgtgtggcagttcctactttgggaactcacctttttagcacaaataagaagctgtaaggcccaaantactgngggtntaaggccctcactagtagg

SEQ ID NO: 951 - DNA, 442 bp, Homo sapiens
cttgtccaagatcatttattgttattattatttttctctcttaattggattcagcgtttctggctcctcacacacatcctctctggtgggggattcaggtttgtgcaaagcacaaaggagcttgtacccacctgggcccccggctagcagcacggccggctttgatcggagcccctcttccctgtccgggctcgcctgccccagtccctgcttctgacccctgagtccggcctcccgagcctctgcctgcaccctgagcatccccaggacggctgggagggccaggtcttccgtgatgcagaagtgcctgagatggttcatgaaatgccctcattgttccccttctgctaaggccccgcgacgcctccctcctgctgtcccacacagggcccttgctgggtcacacaccaaacagcctcaaggaaaaattcagcagctgagc

SEQ ID NO: 952 - DNA, 402 bp, Homo sapiens
  misc_feature (293)..(293): n is a, c, g or t.
  misc_feature (314)..(314): n is a, c, g or t.
  misc_feature (388)..(388): n is a, c, g or t.
  misc_feature (398)..(398): n is a, c, g or t.
tgatcaagaaaacaaggggaaaactgaaatttattgaaggcttacatactgttaagagctttacaaacattctaccttcacagtctttaatggagcaggcaattggggttacatagcttgcccaaggtcatgcagctagaggtggcagagctgagaggccacctagattttttggactcttcgtgcctgccttaccaccccattgcataggcacacgtcaccctgtacttaaacacctggggccatgcctttgccctgaccatagtgcccttgcaaatcagaaagagccactntcattctgagggggacaagantttgttttcctcctccagtgctataaggaggggcatttcccccacagtcttaaatacccattgcagcacagggncagaagcttnttcc

SEQ ID NO: 953 - DNA, 475 bp, Homo sapiens
ttttaacatttaaaaatttatttccaggaattccacctaaaacaatcttctatatcattctatattttggaaaacagtactttgggagttccttctggacactttgctgtgattcaacaccacattcccggtttgaaatttagttccttttctaacaggtgtctatgtttcatgcagaacttccatagttccttttgctgaagatgccttaatagtgatgcatggtctcaattagccattggtgtaggcctaatctccgtgtgctggtgctacgtcaagtgtggtggtggttaggagtcaccttccgtgtgaggtcaagcgttctggctcccgttgtccttgaagttgcatctcaggcttctgggcatggcagagcatgcgttcctgtgactcggctgaggcgcgtgtgatggagacttcccggcagcctcccggacctggtctctccaaggtcagatcttgaaacttctgggca

SEQ ID NO: 954 - DNA, 469 bp, Homo sapiens
cccagataaaaggtaggggaggaggagagagagagaaggaagagtctaggctgagcaacatgaaggggcccccaaccttctgcagcctcctgctgctgtcattgctcctgagcccagaccctacagcagcattcctactgccacccagcactgcctgctgtactcagctctaccgaaagccactctcagacaagctactgaggaaggtcatccaggtggaactgcaggaggctgacggggactgtcacctccaggctttcgtgcttcacctggctcaacgcagcatctgcatccacccccagaaccccagcctgtcacagtggtttgagcaccaagagagaaagctccatgggactctgcccaagctgaattttgggatgctaaggaaaatgggctgaagcccccaatagccaaataataaagcagcattggataataatttctgaaaaaaaaaaaaaaaaaaaaaaaa

SEQ ID NO: 955 - DNA, 434 bp, Homo sapiens
gagtatgatgtttaatgtaagatccagtggcttggcagagttggtgcaaaactgtaaagtaccagattaagttctagtcagtgagttagcagcctaggcacttgggcaaaaaaattggccctgctgtcccaagtcctccaaagccctctccgtatcaccagctaggagctccaagactgatatgccactacttggaggcttgagtagaatccacgcgtcctcagtttccaaagtgacaagagactggccccagccatcaaagcagtagaattttcaggacagggttgaggacagtggggacagaactggacatgggggcctgagctgctgaacatttgctacatgcagtagtctaagaggctcacagctggagaggttagcctgtccaccttcccacccatgtgtggtagggaagaaggtgaccatctagttaa

SEQ ID NO: 956 - DNA, 403 bp, Homo sapiens
tttttcctatttgaaagaaacaaaattttatttatttatggatgacatactgtatatatggaaaatcccagggaggctataaaaaaggatagtagaagtagtaagcttagcaaggtctcaggatacaaggtcaatataaaatatcaattgtattttacattttaataacaaaagattggaaattgaaataaaataccattgtttaaatacaatagcatcaaaaaatgtgaaagaagtagggataattttaacaaaatatgtgcaagaactgtacattgaaaactacgaaatattactgagtaaaattaaagcagatctaaataaatggagagatatgccatgtttatggattggaggactcaacattgttaatgatatcaattatttccaggctgatctatta

SEQ ID NO: 957 - DNA, 489 bp, Homo sapiens
  misc_feature (292)..(292): n is a, c, g or t.
  misc_feature (297)..(297): n is a, c, g or t.
  misc_feature (308)..(308): n is a, c, g or t.
  misc_feature (315)..(315): n is a, c, g or t.
  misc_feature (419)..(419): n is a, c, g or t.
  misc_feature (437)..(437): n is a, c, g or t.
tttttttttttttttcttaatgttcatttattcaacaaatactaattgagcctctattgtgtgccaggttccattctaatgctggagacacagacaacacaaaacagatgtcccctactcaaggggcacatggcacacagggaatagatgcctcattacatctgtttaagaaacaacatagccactgcagagattcacagcaggctgaacacgtgtttatctccactcctcttgacatccacttaaaatgatagttaaagttgtaggaccacccataagggacaaagggaantcggnaggacgggtgnaaggagnagattggattttcaggcaatgtttttggaaggataaaaatctaggatgggacaacaactttcagccatctttctctggctctggacaggggcctgcacgggggnggcacgcagctttggggntgccaggaagtccctttggggaagggtttggggaactggaccaccccggggg

SEQ ID NO: 958 - DNA, 2986 bp, Homo sapiens
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatga

SEQ ID NO: 959 - DNA, 2901 bp, Homo sapiens
cagcctccctctcccacctctgtctgcccgctgcctcttgtctagctgctgtcaggagctgactgcctccagggctggaatcctgtgctccctctgtgcccagagccccacgatgtcggccaacgccacactgaagccactctgccccatcctggagcagatgagccgtctccagagccacagcaacaccagcatccgctacatcgaccacgcggccgtgctgctgcacgggctggcctcgctgctgggcctggtggagaatggagtcatcctcttcgtggtgggctgccgcatgcgccagaccgtggtcaccacctgggtgctgcacctggcgctgtccgacctgttggcctctgcttccctgcccttcttcacctacttcttggccgtgggccactcgtgggagctgggcaccaccttctgcaaactgcactcctccatcttctttctcaacatgttcgccagcggcttcctgctcagcgccatcagcctggaccgctgcctgcaggtggtgcggccggtgtgggcgcagaaccaccgcaccgtggccgcggcgcacaaagtctgcctggtgctttgggcactagcggtgctcaacacggtgccctatttcgtgttccgggacaccatctcgcggctggacgggcgcattatgtgctactacaatgtgctgctcctgaacccggggcctgaccgcgatgccacgtgcaactcgcgccaggcggccctggccgtcagcaagttcctgctggccttcctggtgccgctggcgatcatcgcctcgagccacgcggccgtgagcctgcggttgcagcaccgcggccgccggcggccaggccgcttcgtgcgcctggtggcagccgtcgtggccgccttcgcgctctgctgggggccctaccacgtgttcagcctgctggaggcgcgggcgcacgcaaacccggggctgcggccgctcgtgtggcgcgggctgcccttcgtcaccagcctggccttcttcaacagcgtggccaacccggtgctctacgtgctcacctgccccgacatgctgcgcaagctgcggcgctcgctgcgcacggtgctggagagcgtgctggtggacgacagcgagctgggtggcgcgggaagcagccgccgccgccgcacctcctccaccgcccgctcggcctcccctttagctctctgcagccgcccggaggaaccgcggggccccgcgcgtctcctcggctggctgctgggcagctgcgcagcgtccccgcagacgggccccctgaaccgggcgctgagcagcacctcgagttagaacccggcccacgtagggcggcactcacacgcgaaagtatcaccagggtgccgcggttcaattcgatatccggactcctgccgcagtgatcaaagtccgaggggcgggacccaggcacctgcattttaaagcgccccgggagactctgaatctttttcagaaacagtgagttaaagcagtgcttctcaaaccttgatgtgcctgtgaatcacctaggggtcttgttaagtgcagtctgatccaggaggccggggccgggtactgagagtctgcacttaacaagctcccaggccgagaagccagtgcggcaggttcacaggcgaggcctggagtaacacaaagtgaaactcgtaatagacttcccactctagggcagtggagtcggaagggcacacggggtgcgtctccccggagttcagttttaccagatgatgggggaggggggaaggagttttatgttaaaccatccatgtatttttggagaagagagaggaaaggtttgagaagcactgttccagcctgccctcttcatttagccaatgcttactgcgctagacgcttcatcccacaatcttaaggggcagcttctattagccagtctttacagctgagcacattctggctcagggaggttaagtgacttgcccagtttcagggctaacgaccacagggtctgcactctaaccctaggcatcacatgctcaatgactctctggtgagcgaggacattctctgacctactcgagggacttaagatgctaccttgtgacccagcactgcccaaagtgcttccaaggcagaagcagcaggggatggcgtggtcaagcactcgggaaacctggggctaatcaaatccaatgggggaaatgactaaaagtcttcggtcgttagaagttgaatgggcacagcaactctaagactacagcacacgtcatttcttagctaagcggaccagcctccctgtcggcctggtgttctgtgggatccctctgggcactggtaatcccaagatctgtgcagccccgcctccaggccacatggggctgggcagctaccatttcccttttgcggatgggaggggtaacttgcacctctgacctatcacttccactgcaccccgtctcattcctccacctgccgtggacttggggtcagagactgctgtgtttgagctctgcagcccagggaccgaaaagttggtgtcaatgaattttgcttggtggatgaaatgtcagtggaagaagcagatgagaaactcttgagatcttggtcctgtgttttttctgccaccaaaggccagggtcactgaaggcctggcccacagcaggtgctgagcaaagggaacagtgaggtgcccagctagctgcagagccaccctgtgttgacacctcgcccctgctccctcccatcccttccccctttactcatagcacttcccccattggacacgtggtgcattttgcttgtttattatgttttctctccatcagaatgaaagctcctcgagggcagggactttggtctattgtctgtatttgccggtgcctaggattgtgcctgtatgcaacaggcactcaataaatatttttgctgtagactgg

SEQ ID NO: 960 - DNA, 375 bp, Homo sapiens
ttttttttttccaaaataagagaaacatatgaacatgtgtaagcagatacaaaggaagcaatgggaagggagagaataaaggcactgagggaggagaataggaacgtggacacagagaggaggtacacaaaggatgacagttttgtccaaaacatgaaaaaggcagacagtacaggcacagaagaatatacttggatgcatacaggattagatgcagtgtgcaatttcaattttggtattccactattcagttatacagtgttatatatcatggtaagtaatgagatactagtgttttggtacaaataccactatttcagtattttaataatgtctgaaacacaccttacttacatcttgagagcaggattaaca

SEQ ID NO: 961 - DNA, 2801 bp, Homo sapiens
ttacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccgcacacaaacaatgcaaacggggcaggggcggggggggggggggcagagggcagggggacgggtcgggacaccagtgaaacttgaaccgggaagtgggaggacgtagagcagagaagagaacatttttaaaaggaagggattaaagagggtgggaaatctatggtttttattttaaaaaaaaaaaa

SEQ ID NO: 962 - DNA, 424 bp, Homo sapiens
gcggccgccgcccctggagtaggggactcagtggccacgaaggccttccctgctcgcgacctttccacgggaaggcacgaagcttccgatgggggccccggggcgctcctgacttttctacggcgcgagggctctgactctgcggttcaggtttgaaagtcctttggaagctcgcaagtggtggtctcccaccacctcctcggtcatcgcaggaagaaggcgcagtgagggcgggagtctggatgagcggagagtagccaccgcggagaagagtgcgggcttgcaggagccgacgaagataactcgaaatgtgggcaggcaggtgttggtgggtcttgaaagtgggaaagcacgagaaaagaacaatgttcgcgtccgcttagaatacggaaacaagtgagctttaaaggaaaatactcattct

SEQ ID NO: 963 - DNA, 269 bp, Homo sapiens
gctctcagaactttattaggtggggattgggcaagagaaaacccctgaaacagttgcccacgtggttcaagacaactagaatggagatgtgttgcttggagataccttagatttttaaaggggagctgactggctgaataactcagatttatttttttttttttccatggtccagcccagtctctagtaagtctctagggacatgaccagaccagaagccccctgttctatatgaagacaaacaggtggccatacttgggtggagggat

SEQ ID NO: 964 - DNA, 2202 bp, Homo sapiens
aggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacacttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctgagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctg

SEQ ID NO: 965 - DNA, 475 bp, Homo sapiens
  misc_feature (322)..(322): n is a, c, g or t.
  misc_feature (459)..(459): n is a, c, g or t.
ttgttttaaagacacatgcacacgtatgtttattgtggcaccattcataatagtaaaacattttctttttggtgtgagagaccctcccattccttagtaaaaacgtatttacttgcatgttattattgtccttacaaacttgtttttccctagagcaattgattttgctttaggtactagctgaaggtctagaggcaatacaatttaggatccttgtctagaaatcaatatgattcaattcttttcaagccaaatgatatctgtaggactccagttgtgtgcaagccctgtgtgggagcctcaaggcatctgcgttaggccnagcttccctattcttgggaaatcagctttgcttgattgggccctatattggccatggtttaatggtttggatgggtggccggggcctttataaaggcataccaattttgcaggtggctccctctcaggggtaggggngtcctttgccccaagg

SEQ ID NO: 966 - DNA, 3002 bp, Homo sapiens
gccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttgaaatggagtctcgctctgtcattcaggctggagtgcagtggtgcgatctcagctcactgcagcctccacttcctgggttcacatgattctcctgcctcagcctcccaagtagctgagactacaggcacatgccactacacccagctaacttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtccaggaaacgggtaaggggaccatttctgcattgctggtttcccctcttggcagggtgggcatgaggcatcactgttcctgctccctcactcctgctcctcatgctcagcctgccagctcggcctcaactttgtgtgtctaaagtggaactgaatagtagctgtgagaagataggaaagaggtagtgccaatctccttgcccagatcataaatccagactcagcagggtaaccacatgggcaagcacaaggtaggtgcttggggaaaggggaagtaattggcattctgtgtgataccaaggagaccatttggattttggcttctaccaaagagaatggagaattggttgacctaaatggaaccagtccctttaagtaaggggaggaaagggggtgctggaagatggccctcttcccaccacctagatcatagcttgaactgaagccaaggacagagtgctgcccccttcggcatttactgatgtgccctctttaaatcatgatgttatctaacccaaacccagacccaggacctagtcacagctccaacctacacttcctattaatcttaaaacaaagcgaaacaaacacaaaaagatatcagcattgtagcctccaatctgagcccatttcccttctctggctaccatacctccttctcctatatgataccattcactactttgttcaattatccagtctagacctgcatcttgaggccacacccagccttctcactccccacacccctctttcctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggttccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagagatggagcaaagtgagggccgagtgagagcgtgctccagcctggctcccacaggcagctttaaccattaaaactgaagtctgaa

SEQ ID NO: 967 - DNA, 1199 bp, Homo sapiens
gtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgacgtcacatggagcacagaaatcaatgttagcagatagccagcccatacaagatcgtattgtattgtaggaggcattgtggatggatggctgctggaaaccccttgccatagccagctcttcttcaatacttaaggatttaccgtggctttgagtaatgagaatttcggaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgct

SEQ ID NO: 968 - DNA, 372 bp, Homo sapiens
  misc_feature (290)..(290): n is a, c, g or t.
  misc_feature (309)..(309): n is a, c, g or t.
  misc_feature (326)..(326): n is a, c, g or t.
gagactcaatgtaaatgtttattgatagatgaatggataaagaaaatgtagtatacacatacaatgaaatattattcagacttatgaaagaaggaaatcctgccatttgtgaaatatggatgagtgtggaggataataggctaagtgaaattagccaaacacacaaggacaaatactacataataccacctatgtgatgaatctaaaatagtcaaactcatagcagcagagagtggaataagttgttgaagggaacatgatgaggtggaatccaagttattagaccaagnataccaattttcagttacntaagttggataagtccnagggatatatttggtaccgccttaggagcccatggggtaaataata

SEQ ID NO: 969 - DNA, 1049 bp, Homo sapiens
gcattccccacacaacacccacactcagccactgcgggcgaggagggcacgaggccaggttcccaagagctcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggttcctggagtcactgcagagggagtgtgcgaatcaagcctgaccaagaggctccagaataaagtatgatttgtgttc

SEQ ID NO: 970 - DNA, 463 bp, Homo sapiens
aacgtttcacctgataatttaattgctttattatttgctataagagtcctgttacattaaaagaatgtttaagaaataacacgtaataacaattagctttgggaaattactctgttacagacacaatttactaatttggtgattaataaaatcaagacaaataagcatgttcacaagctatcatttaaaaattcaacaggttgttttttggccttcaaatatgctctatcttgcttatcagccattaagcagcaatggagaagtgagactgtcattttataattacatttaatctctagtttctaaatttcatggcaaagtactcaatcaagaaaaaaatgttgatcaaaatatcataaagctacagtaactaaaacaatgtgatggtggcacagaaaaaggcaaatgaatcaatgaaaacaaatagtccagaaagtcacagatatctgagaattagtatctg

SEQ ID NO: 971 - DNA, 768 bp, Homo sapiens
atgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatga

SEQ ID NO: 972 - DNA, 442 bp, Homo sapiens
  misc_feature (419)..(419): n is a, c, g or t.
  misc_feature (424)..(424): n is a, c, g or t.
  misc_feature (432)..(432): n is a, c, g or t.
  misc_feature (438)..(438): n is a, c, g or t.
ttcacagcctactatcagcaatagtccttgtttattagaatctgcagatgtccatattacatcaaatataaatatatattatatttacatttccttcttagctttcaatttaggtgagtgtatttatagataatgccactaacgcaccactattctaatcctcagtgcaactcataccttctttccattagatgctcattaatgtaagacagcatcttaaaagaggggtactgttcttttttaaaataaaaggaaagaaagggaatccaagaatggaggtctagacatttcctaagagatttttgttttgttttttatacttagaaatacttgaaaaatgtggtccctttttggtagtactagtctctacttggggacaagaaaatagaatatgcaactcagaaaggaaagagcccaangacgngagaaccnggcttngtta

SEQ ID NO: 973 - DNA, 207 bp, Homo sapiens
tatttgatttattatttatttagtttattaatcaattctctcagggatcagaaggcatgcccttggggtcttctctgtccactttctaatggttgtgagcttgagcaagtcttgtaatctctggctccaccatcctcacctgtcaagtgaggtggccagattcaaggattatctgtctttaccttcccaagatctgaagatagggat

SEQ ID NO: 974 - DNA, 485 bp, Homo sapiens
gcttagaaaattcagctttaatggtccagccttctgtctgagtctagtagtccagggcacagatgagggccacaccacgctttatccagtgtcgctggggctgatgggtggggatctccacagcaatgacatagtttgtagagtgtcctgtggttgatagtgttccagcacgagtcagtgtcttgtagatggggcacaggtaaaagtcctggtcctgggccttgcggttgggtgttggcaagagccagataacggccatctctgtgtacagctccttgggctgagactcagccagctggaaggcctctggatcccagcgggcaccttccaggaataatccatggatatagcaccctacttggggtctttgtgttaactctgatggtgcctcaaaacatcacctgtgggtagacacagacacaccccacacacataacaatacccagaatctgggttaggaggcacaaaactcccttctgagagag

SEQ ID NO: 975 - DNA, 297 bp, Homo sapiens
gcgtcgacttttttttttttttttttttttccaaagattcttttatttacatttacatacgattctgaaaaagcgtctccaagctaccacttcttgtagttgccattgtctcattccaccaaaaaacatctcagaccgcccgcggccaccccaaatacgcctgtccactgaagcctcactaaaaggaggaagcgctgatgtcagggttacttaaattcccaggctccggatccctagaagaggtatttccctttacgcccgcgaatttgtcatagaaggcagggcactaggtcgacg

SEQ ID NO: 976 - DNA, 376 bp, Homo sapiens
ttttttttcaggcccgatggtttttatttctttcagttatgcttgcggctggagtggggacgggggaagagcccatggcctgggctccctggagaccagggctgatgataccagctgccataggtgaggtaccaggcaaaggtgcccactgcggcgcccaccaccttgtgagtgtactggtggaaatagatgacggtacagagcagcaagaagttccagaggcccagcagcagcacgttcagcaggaagacaaggcgcagtggggcgccggcaggaagcccatgggccaggtacttggcgaacacagctgcttcctctgccatgagcaggcagcaaaaggtgagcaggaaggtgtgggaggagacggtgtagcctc

SEQ ID NO: 977 - DNA, 280 bp, Homo sapiens
  misc_feature (248)..(248): n is a, c, g or t.
  misc_feature (264)..(264): n is a, c, g or t.
tttttttttttttttttgcttggaaaggggccctttattcaacaaaagtatcataagaaaagtggcttagtctcaccctcctacccaattcctgctattcagactggccaggggtcctgcatcttcttcaacattctagctgatgcctagcgtttgtacagtcctttgcagcttgcaaaactcttatttgttccagaaaactaaagcccagagaacctacatggcttgtccaaggccaggcagctttnggtggtgaaagcctanccacaaggctttgctg

SEQ ID NO: 978 - DNA, 459 bp, Homo sapiens
tttttgttcataatttttattcaaaaatctgttcagtggaattcagagtcttgtcaaaatggttgataaacccacactgttaggtttcctctagaaaagccatggagaagaaaaaaagaatttaagaaataatacaataattcctgtgagaagaaaggctgtctcggactggcatgtggagggtgaaaggagaagaaaaggctagcctagggcaaaatacactgggctgtaaaaggatacattagagaaaagcagtttaattctgctctttcttgctgctttcacaccttaataatgcctaagggcagcctcctatgcagagatctgggagaatgctcaggcccctagtgcaggcatccacaggagtgagattaaggtgagctggagccctgctcagctgtcagcctagccttcagcactgagacctccatctttccctctaaaccccagagctggtgg

SEQ ID NO: 979 - DNA, 2714 bp, Homo sapiens
aatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaaaaaaaaaaaaaaaaaaaaaaaaaaaaaaaaa

SEQ ID NO: 980 - DNA, 375 bp, Homo sapiens
tttttttttttcaataacaaatgtcattttatttatacatatacacagtacttctctagcccttttgtgcaaaaggtgtggatgtatctaacattgctgtgtgtgaatgcacaagaaaaatattaaggccaaagtgatgaattacataccaggcaaagaatggatgaaggcccagacatcatcaactgtccatatagatggctctgtttgtgcaactggtagcaagtcactgttctcaggcattttccgaattctcacatcccgaagctcacgttctctttcccgctcgctctgcctgcgcagacgagttgtcatagcagatggcacagaatcttcatgagaagccaagtcttcttctgcagatggataagtaat

SEQ ID NO: 981 - DNA, 478 bp, Homo sapiens
  misc_feature (450)..(450): n is a, c, g or t.
taattcaaaaaggtattttattaataaagtctgttgaaaagcatggtttatattttcaacaaagtttctctccaaattaaaatcacaaccattagctgacaccccttccccacctccaaatgggactgaacatgctcctgataccttaatcccaagcagatagaaatgcatgcaggtgaaacagagaacagagaaaggtcaccctcagtttctctttcctgtttcacaaatcatataaattaggggaaagagagaggcaggtatactctaaaacaattttatccaggggcatagaggtttccttccctaaatagaaatgtgaggtgtggaagagaagcacatcaccttaatattacttctttataatctgcctccctttcagaatgtgtttacatcatccacagctgggcctctaaagcttagaacagtggctgaaacagatcatgcacntcaggatcattcgttaagggatatacaa

SEQ ID NO: 982 - DNA, 1389 bp, Homo sapiens
gcccccgcgccggcggcggcgcggcgcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctg

SEQ ID NO: 983 - DNA, 422 bp, Homo sapiens
tttttgccctgcaccttgagtaaaagtttcctgaggcctccccacaagcagaaaccaccatgcttcctgtataccctatggaaccatgagccaactaaaggtatttctcatgtatttctttatagcaatgcaagaacatactaatacagctaagcagaggccatcaggaccagcaacagtctgagctggatgagagacaaagctaaactttgagaagcagcaggagctgccaggggacagaaaggaaggatggagtcctaaattccaggatgtctcctttaaatctgtaagaagctcagccactgtctttttacctgactcctctgggaaagagtttccctaggttaagccatacagggatagggcaggagatgccatttggatctaggagcagaggtcagagactcagcaggaagagtgtc

SEQ ID NO: 984 - DNA, 425 bp, Homo sapiens
  misc_feature (347)..(347): n is a, c, g or t.
  misc_feature (377)..(377): n is a, c, g or t.
  misc_feature (412)..(412): n is a, c, g or t.
  misc_feature (418)..(418): n is a, c, g or t.
cagggttttactatgttggccaggctggtcttgaactcctgaccttaagtgatccacctgcctcggcctcccaaagtgctgggatcacagtgtgagccaccacacccggccacagaaggaaggaatttttaaatgaggaaactttacagagttttctggaatgaaataaagatcctgtatcaacttcaacacttgcattttattttccttaatcattacataacacattcaaggcaggaatgaatatccgttttgataggtggggaaactgagactgagggaggcaaagtggtctgcacagggccacaatcatgaggcactaagccagccacgggcacagctaggantccagccccaagtctttctcgttctgaagncgaggttctttgtgttttccctacttcacagcaancatgantgctggg

SEQ ID NO: 985 - DNA, 429 bp, Homo sapiens
tttttcaattgattcaatatttattgatgcccagctacccatcttctcacaatcttggaaggggtatgttggacaataggcaaggaacataccctttgccttttagcaaaaggaaccgatgacaaaagttagaactgcgtggccttttctgggtctgaaattctccaagagggagagtgtttggctctatgtttgtgcccctgcagaatctagtacagtgctatgtgccatgcccagcttaaattcttactgctagtgaatgagggccccctaggactcagatcctcatagctccagctccgtttgcccagattaatgttttccagacccaaccagctgcagtcttctatcccctattaaaactaaaggaagcacaaattaatagaaatatcaaaccattggcttttgaaggtgggtagaaaacagcac

SEQ ID NO: 986 - DNA, 600 bp, Homo sapiens
  misc_feature (589)..(589): n is a, c, g or t.
gtaactggttcctgcaaggcaggcctacatgaaaatgtgactgataagatttgtttttaatatcctccgactccctttttcaaacccttcttctgtctatacctgcatactcctttccatacaagttactagttctctgacagccttgaggaagaccaatggtaaagccactaatggtggagtatgaactcagtgatttccattgatggaatacatgtcacctttcagaatgaggtattgctcaccctctcccaaatgaggtagcacaggctgttgcctcctcatccactggtaagacacaactagatttttatactcatggccaaaccactcctgcttaataccaacttacttcaactcagattgcttgagactcattgtggttcatctataaggcaaaactgagacagggattaaaaaacctcatctctaattcctgctttctctacattgaggtgtgtcccttggagctgccaagtcaggctgaattttcagcacattccattcaccctcagtgagtctgcaagttgcatagaacctaaagaaacaatcaattctgtcaggggaaaataaatcaatcccaccattnttttgtctttg

SEQ ID NO: 987 - DNA, 429 bp, Homo sapiens
  misc_feature (23)..(23): n is a, c, g or t.
  misc_feature (25)..(25): n is a, c, g or t.
ttttttttgttattaaaagcaantnaatgagggcagagcaggaaacatgcatttcttttcattcgaatcttcagatgaaccctgagcagccgaagaccagaaaagccatgaagactttctgcttaattcaggggcttacaggattcttcagagtgtgtgtgaacaaaagctttatagtacgtatttttaggatacaaataagagagagactatggcttggggtgagaatgtactgattacaaggtctacagacaattaagacacagaaacagatgggaagagggtgtccagcatctggtggttggcttctcaagggcttgtctgtgcaccaaattacttctgcttggtcttctgctgagctgggcctggagtgaccgttgaaggacatggctctggtacctttgtgtagcctggcacaggaactttggg

SEQ ID NO: 988 - DNA, 427 bp, Homo sapiens
  misc_feature (324)..(324): n is a, c, g or t.
  misc_feature (411)..(411): n is a, c, g or t.
  misc_feature (421)..(421): n is a, c, g or t.
aaccctgctcttttattacatcagtagtatagtaagtgcataaagtatagaagagaaagaaaatttcaggagagaaacttacaaaaaacttgaagtttgatgcgtcaaacacaaaatagtttaaaacagtttacagttcttataagcactatcataattttttctacccaaataattcaggtcttcattccatttcaaactgcaatccagaaatgaagattttcagtgtaaaaactgttcagagaaatctaattcattatgtaatacatcttattaatttcagttttcaagtattcaagtaatgcatacccaagtattttctgnttacagcaacacatttacagactaagcctcaaacatgggggaaaaattccttttaaaataattggtacacttttctggtccaacggnatcaaacccnagacat

SEQ ID NO: 989 - DNA, 1360 bp, Homo sapiens
tcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcaaaaaaaaaaaaaaaaaaa

SEQ ID NO: 990 - DNA, 517 bp, Homo sapiens
ttaattttgaatcatttatttggaggaccataggatttacattctttttaaaatcattatgaaaacaggatgtatgtcaacatctatgatttgagtgaactagggaaccaaatctgggcattcaaacattttatatcagaaagactgtgtttgattgtattaaagtgtaagctattccactaggccaggtgagtgaccccaaaatggtcaaatgctcaattttccaaatatcagcattcactctgtcacttctaaatactactaggactgatagattgcactgaatatcttagtaatatcctactcttgaaagagagagctataaaaatcaaatgtgtattcagaagatttctttatctgtgctgccatccatcaaacttacttggtttagatcttgagggcggaaatcttgtatttcattctaaaatatatatgcatattttccaaatggtcttgtactataattgatcctcatcccccataagaaggagaaataaaaattggagcacactaccct

SEQ ID NO: 991 - DNA, 461 bp, Homo sapiens
  misc_feature (315)..(315): n is a, c, g or t.
  misc_feature (357)..(357): n is a, c, g or t.
  misc_feature (381)..(381): n is a, c, g or t.
  misc_feature (446)..(446): n is a, c, g or t.
tttttttttttatcagtcctcagatataatttaatcttaagtctttaaaggcccctgaaacaaaagtatactttttatttaggcttcctcactttctggtagtcactttcacccagtctccagttttaccctgacttagagtccacaaacttcatcagaccctctgtgctcatggacttgggcctttctagagggaagcctaaggtcaggctccagatgagctgtgccagtacacccaatgctcgtgacaccccaaacaggaccgtgtagtaattcatctccgtcatgccataatactggagcagcaccccactntgagcatctacattgggccaaggattcttggctttaccctgntctaagaggacattgggcacaatnttgtacagctgagcaaccaactttaaacaatgggggtcattagggaggtttttcagagcaaactnttgctgacaggtata

SEQ ID NO: 992 - DNA, 423 bp, Homo sapiens
tatttaaacattttattccttaagtgaaaacagtctaggaatcatatggcagctctgtggtaacattactttatctgagaaatcctcagcaacccaagtttcttctatcgtgttgttctactattcatggttcacattcccaagatcagctcatggtccaagaaaggtgttttgctgccagccttcacattgacactggagtccacaagaagcaggaaagaataaatagcagcaaaagatacacaccacttatcttttaaagaagttgccacacttcacttttaatgggccagaactttgccatgtttctacacctagctgaaaggaaatactgtgtttattccaggcttcaatgtgaatcaatgaaatcagaagctataacattaggggaagacttcaacaggacaaggcacacctctccca

SEQ ID NO: 993 - DNA, 247 bp, Homo sapiens
gtttgcttgtttttgttttgatttccccagataatcttagctctctaaacttcccgtggcataagataagtaaacgtttgtgtggctggcacagagtagtgctgtaaacaagcacaacttgacactgggccatatgaggatcatcacagatttaaaggcatacaacaccattcaaaacacagataggagccacaatgggaagcaaagtctgaaggtgccatgggagggttagatagggagggaagaa

SEQ ID NO: 994 - DNA, 1417 bp, Homo sapiens
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgta

SEQ ID NO: 995 - DNA, 408 bp, Homo sapiens
caaatacatgagaaaacaatccaagaatcactgcaggaagaaatgatcatttaagctcaatcatgttcttttgccttttaatttcatttaagagattaatattagagtcataaaagctttacagtttcaacacacatacacacaatcacagaattaaatatctttactccttaaaaaaaaatgagttccattttgttcaatgtatcacaatcaaattttagtctaacaaaatccggtaaaactgctttcattaaatagagcagctgccacttacctttacatattttacggatggaactgagttcagtactgatccaaggatgctggcatcaaagcccttacacggaactatccctaaaggttccgtatttcccgtaatataccaccatccctctaaatttataatac

SEQ ID NO: 996 - DNA, 460 bp, Homo sapiens
  misc_feature (5)..(5): n is a, c, g or t.
  misc_feature (20)..(20): n is a, c, g or t.
  misc_feature (119)..(119): n is a, c, g or t.
  misc_feature (284)..(284): n is a, c, g or t.
  misc_feature (324)..(324): n is a, c, g or t.
  misc_feature (337)..(337): n is a, c, g or t.
  misc_feature (358)..(358): n is a, c, g or t.
  misc_feature (456)..(456): n is a, c, g or t.
agcangccttatagttcctnctttattaaatgacggagtagggatgttgtgattacagttgaaggcgacgtgttagaaaggacaggtgcatgaaggcagagagtgcccacagactcggnctctcgaaccggggcaggagggaacaaggtgagctgtgcagcccacaggacgggcgggcctgggtggacacagccccccaagttggccaagctgagtctctggggcgagtggctcccaggagaggcctggctgagcaggcagagcaccctgggaccccagggcanaaggacccctgccctccagtccccaagacccaggcccgtntccactcatacanggcacctacatgtgacgtcanccctgaaaaggtaacaggaaagttagaacaaaaacaaaaccccaaaagtaaaaaggctacgtgtagcagagtaattccggaaacgtttttttaaaggnggta

SEQ ID NO: 997 - DNA, 171 bp, Homo sapiens
  misc_feature (169)..(169): n is a, c, g or t.
ccagaaatggtgttccatttattcactgaaaaagagagagattaggccttcttcattcattttctccattcttgccaaactccctcccctcattttttccaaaataacaacacactgagaaacatgtttgtacaaaaaccacatattattcccccccctcacaaaatcngg

SEQ ID NO: 998 - DNA, 475 bp, Homo sapiens
  misc_feature (401)..(401): n is a, c, g or t.
  misc_feature (409)..(409): n is a, c, g or t.
  misc_feature (433)..(433): n is a, c, g or t.
  misc_feature (440)..(440): n is a, c, g or t.
  misc_feature (450)..(450): n is a, c, g or t.
  misc_feature (455)..(455): n is a, c, g or t.
tttttttaggaagttgatcaaatgcttcgaccgtttatacaccaacggtcacagatgtttaaggatttgggggatctacgtgaatccagcttgtggacactgaaaatgacgttgctcttatagtgaaaaagaagcgagaatatttactgcacatcaaatagtgaagacacaccagctgaacactgagggtatttgagcttcgagttgtgaagatgatttgtgtagctagcaagcttacctcatttcccacttactttacctatttcttctaccagttttaagcaaaactctccttccatgtgactgtaaatcatctctataacctaaaggctgcttgaatgggcccgatgttcctgacgcgtagggggagccacacacactgggggtctctttgagggttnggagggtngggagggagggagagggtgaacgnttagcantccgagctcngggtncagactgcccgagggttatt

SEQ ID NO: 999 - DNA, 293 bp, Homo sapiens
  misc_feature (18)..(18): n is a, c, g or t.
  misc_feature (291)..(291): n is a, c, g or t.
atagccagcaactttttnttaatgttacatatactattctcaaggcacatctgatgatatattttataacacagtaggtgtcaaagtatgtttaacatatgatttcttcaggatccctcccctttttgaattccaaatggaggaactgaaagtgcgatgtaaagactggcgatccatattctatctttggcaagcttgtacaagcactattgtaaatgtaatgtaaaagaactgtaaactaggaacttcttcagtttatgaaacaccattcaggactgctgcttcttgagngt

SEQ ID NO: 1000 - DNA, 423 bp, Homo sapiens
ttttttttttgttcttcaagtgctttattgggtagccagcctggccaactggcctcatgtatccaaccaccatatataaccttgtttctgggagaaaacatgctctaagttccaacttttgaaactatcttttggagcgcaactccctcatacactggagactgcgtgtgctaatctttctggaatgctggatattttttcccccagcagatttactttgctaatggtttttggctctggcgagctttagtacaggaacactcattgtattgtgggtgtcagagtgcaagaataacagccgaagctgaaggtggtgaggaaggactgctcccggaactcaagcagccactatggaaaaaggcaggaccacgcccaggtgccaggcctctgttctcctactttcagcttcctctcagacaggag

SEQ ID NO: 1001 - DNA, 484 bp, Homo sapiens
tttttttgcatagttgtcactttattatattattttccttctgtgacctttccaagtctgaaacagtcccagggacttcttttggttagttatttgcaatcaccgaattgatccagtcgatgtaattggagacccgcgtgaagacggagggcttgtggtagtagttgcagccgaggcgagacccgaagctgacgatgccgtgcacctgccaccggccgtcagacgcctgacagttcagtggcccgccagagtctccgttgcagctggagatcacgccatcacccccagcacagatcatactggttttcacgctgctgccccaccaggcagagctggagcaggtggcatagtccacaaccagcaaccggccctgctgcaggacatcaggaacagccccgttggtctgcagccttccccagcccgtgacgtagcaggggtagttgttgggtagaatggtgccggcagaggggaggcaggccagctg

SEQ ID NO: 1002 - DNA, 4211 bp, Homo sapiens
ctcctgcatagagggtaccattctgcgctgctgcaagttacggaatgaaaaattagaacaacagaaacatggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggatccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttttgagggtcaggagtccaggcccagcataactgggtcctctgctcagggtgtctcagaggctgcaatgtaggtgttcaccagagacataggcatcactggggtcacactcatgtggttgttttctggattcaattcctcctgggctattggccaaaggctatactcatgtaagccatgcgagcctctcccacaaggcagcttgcttcatcagagctagcaaaaaagagaggttgctagcaagatgaagtcacaatcttttgtaatcgaatcaaaaaagtgatatctcatcactttggccatattctatttgttagaagtaaaccacaggtcccaccagctccatgggagtgaccacctcagtccagggaaaacagctgaagaccaagatggtgagctctgattgcttcagttggtcatcaactattttcccttgactgctgtcctgggatggcctgctatcttgatgatagattgtgaatatcaggaggcagggatcactgtggaccatcttagcagttgacctaacacatcttcttttcaatatctaagaacttttgccactgtgactaatggtcctaatattaagctgttgtttatatttatcatatatctatggctacatggttatattatgctgtggttgcgttcggttttatttacagttgcttttacaaatatttgctgtaacatttgacttctaaggtttagatgccatttaagaactgagatggatagcttttaaagcatcttttacttcttaccattttttaaaagtatgcagctaaattcgaagcttttggtctatattgttaattgccattgctgtaaatcttaaaatgaatgaataaaaatgtttcattttacaaaaaaaaaaaaaaaa

SEQ ID NO: 1003 - DNA, 1088 bp, Homo sapiens
tgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatgactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgagaatgtttttagctggtggcaataaatattagaagcctgcagaatccagctacgaatatagagggttttgctcttgggccttcgtggc

SEQ ID NO: 1004 - DNA, 743 bp, Homo sapiens
  misc_feature (550)..(550): n is a, c, g or t.
  misc_feature (710)..(710): n is a, c, g or t.
cttcaatagatatcccaaatatacacacaatcctatttatttgggtctaggatgtaaatataatttaactgtgtgctaagtgctttaggtaacacaagcatttatctattgtaaaatgaaaattcaattgccatcaaatcagaattttgatttcagtcagaaatgcaataaattatgccataaggaatatatttgtatacattttgtctcagatattttctcatgtggtattgtgaagggtaacaagtataatattatctgtaaagaatttaaaaaaatatttttaaatataactaatagtatatactgattttgacagttttctttccagaactcaaaacgaaagctatttttaaaaattaggtgattttgataactattaaactttaatcaatgcattaagaaacaggcagctggcgatctaacgcataagttgctctttccttactgtatttttcagaccacttgcgagtcagttctaggtaaagacctggtttatgaggacggtaatctaggtacactgtattactggttcttttgggaacagctntttcaatctgagttccttcatgccactcattaaaagaggtgatagaaattaagcttgggcgtgtctgaagtgcggcactcagaccaatttcataatacttcccattgattcggttccgagtgttttgcgtgtccatggacggatgctggtatcatgtatnctgggccacacttgggataaatattagtggatt

SEQ ID NO: 1005 - DNA, 1295 bp, Homo sapiens
atcaaataccagctctgccagtaagaagttgcatctcccagtgaaatgctgctgctgccatttcaactgttagctgttctctttcctggtggtaacagtgaacatgccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaagtgaagcctgaggcctggctgtccagtggccccagtcctggacctggccgtctgcagcttgtgtgccatgtctcaggattctacccaaagcccgtgtgggtgatgtggatgcggggtgagcaggagcagcagggcactcagctaggggacatcctgcccaatgctaactggacatggtatctccgagcaaccctggatgtggcagatggggaggcggctggcctgtcctgtcgggtgaagcacagcagtttagagggccaggacatcatcctctactggagaaaccccacctccattggctcaattgttttggcaataatagtgccttccttgctccttttgctatgccttgcattatggtatatgaggcgccggtcatatcagaatatcccatgagccatcatcatgtctcctctcccattcgcaataagctaccaagaagcccaagatatcagcccaaaaatcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaat

SEQ ID NO: 1006 - DNA, 3632 bp, Homo sapiens
agctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 1007 - DNA, 311 bp, Homo sapiens
  misc_feature (158)..(158): n is a, c, g or t.
  misc_feature (246)..(246): n is a, c, g or t.
  misc_feature (267)..(267): n is a, c, g or t.
  misc_feature (279)..(279): n is a, c, g or t.
tgcgtttatttaggtagtttaattctctacttttattatgttctaatacaagtaactttagtatttactgaagttttaacaaataacctaaataaaccaaaacaatgttgagagaaaagtatacatgcaaatgagcaaaaagcttaatatttttaaanccaaatttttaaatacctcaggaaactaggttatatcaaaagagggaggtaatcttcaccttcttgccaccaacatcctgggataggntatgggggcctgtggtggggngggatttgtggncccccccaaagggatatggtccaatccctaac

SEQ ID NO: 1008 - DNA, 458 bp, Homo sapiens
  misc_feature (414)..(414): n is a, c, g or t.
  misc_feature (452)..(452): n is a, c, g or t.
tttttatctttatgtttataaatttatttaatttccaagacttatgtgttcatctcaatccttgacatactcatctgccagacacaaaaaatagtggtctatttaagaggccttaatgaatgacaacatttttgaaatatgctatatgagtacaaatatttccagagcaaagagggaaaactgttgattgggtagacaatcaaattccaagcatttatctgatttacagaagtacatctactttttgtttttcactaaatgaatacaaccacttttaatatatatgtgggtgtggctgtgtgcgtatttcaaaacacacacgcacacacaataaaagaaacatttcatagtggcaaaattttagtgcactgccaaagtgctacaataactgtcatccacagacatccacatgcnaacactactggactagtacactagagccaataaggagngtattt

SEQ ID NO: 1009 - DNA, 216 bp, Homo sapiens
atttataaagaaaagacatttattttggctcacaattctgcaggctgtactggcatggcaccaacatttgctcagcttctggtgagggcctcaggaagcttacagtaaaggcggaaggtgaagggggagcaggcatatcacatggcgagaaagaggggagaggtctcagactcttttaaacaaccatatctatgtgaattgagtgagaactcactc

SEQ ID NO: 1010 - DNA, 3159 bp, Homo sapiens
ccaccgcctccacctccatcgccgtcgggggaggggccggccggaccccggggtcactgccgaggaatgaagagaggcggccgggccccgcgctccgccccggcctagggccttgccccgggagcccgcgaggtggaggcctgaattttgatctatgttctaccatacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaaaaaaaaa

SEQ ID NO: 1011 - DNA, 355 bp, Homo sapiens
tttttaaagatatagacaggcattgctccgagccaagatcaaatgtggagaagcagtggctgttctgacaggtggcggtcttgtctcgatgtgagcggagtccaacagacgctgacatctccggtgaatggcttcaatgataattttaaaaaatcatggtggctgctttatggataatatacaattttgcaagcctcaaacggaaggtctacaatggcataattaactgaactgaactgcaaattggatgcacaaaaatcctacgggtttccccttagaaaggaagaatatgaccttattccaagaccaagatcttattcatagtatgtattggcaatttagctgtcaggtttaa

SEQ ID NO: 1012 - DNA, 483 bp, Homo sapiens
tttttttttttgaagcgcttaaatctttaatgtttttggacaacacagtctatatgttttctgcataatgtatcatttctttaaactatagtattaaaaataatttcaaattgtaatgaaaagtcatttggctttaaaaccacccaggaagaggatataaaatgcgtataccaaaagactatgatgcggcttccagtgtttttctgatatagatcataataatttaaaaaggcttttgtcaggctgtctgaatacatcaaatactttctcatttctgtgtcggctgtgaagctctaactatagtggcttctctagcaggtattctccgcacaactgtgccaaatcgttctgaggacacccagattctcctccttctcaaaacagacattcctgactgggtcctagggcagggagaggggcgttggacccctactgccctctgggttctccgagcaccaggacttgttgctccggcgggaactc

SEQ ID NO: 1013 - DNA, 444 bp, Homo sapiens
gagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacacccaaatgtttgagaatctttatggagaccatcaaccctatgagctacacta

SEQ ID NO: 1014 - DNA, 425 bp, Homo sapiens
gggaggagagaaaagccatggccgacaaggtcctgaaggagaagagaaagctgtttatccgttccatgggtgaagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatcgttctgtaaaaggtttttggaattatgtctgctgaataataaactttttttgaaataataaatctggtagaaaaatgaaaaaaaaaaaaaaaaaa

SEQ ID NO: 1015 - DNA, 2044 bp, Homo sapiens
caaagacaaaataatttactagggaagcccttactaacgacccaacatccagacacaggtgagggagaagaaatttcctgacagccgaagagcaacaagtatcatgatggggtgctggattttgaatgagggtctctccaccatattagtactctcatggctgggaataaatttttatctgtttattgacacgttctactggtatgaagaggaggagtctttccattacacacgagttattttgggttcaacactggcttgggcacgagcatccgcactgtgcctgaattttaactgcatgctaattctaatacctgtcagtcgaaaccttatttcattcataagaggaacaagtatttgctgcagaggaccgtggaggaggcaattagacaaaaacctcagatttcacaaactggtcgcctatgggatagctgttaatgcaaccatccacatcgtggcgcatttcttcaacctggaacgctaccactggagccagtccgaggaggcccagggacttctggccgcactttccaagctgggcaacacccctaacgagagctacctcaaccctgtccggaccttccccacaaacacaaccactgaattgctaaggacaatagcaggcgtcaccggtctggtgatctctctggctttagtcttgatcatgacctcgtcaactgagttcatcagacaggcctcctatgagttgttctggtacacacaccatgttttcatcgtcttctttctcagcctggccatccatgggacgggtcggattgttcgaggccaaacccaagacagtctctctctgcacaacatcaccttctgtagagaccgctatgcagaatggcagacagtggcccaatgccccgtgcctcaattttctggcaaggaaccctcggcttggaaatggattttaggccctgtggtcttgtatgcatgtgaaagaataattaggttctggcgatttcaacaagaagttgtcattaccaaggtggtaagccacccctctggagtcctggaacttcacatgaaaaagcgtggctttaaaatggcgccagggcagtacatcttggtgcagtgcccagccatatcttcgctggagtggcaccccttcacccttacctctgccccccaggaagactttttcagcgtgcacatccgggcagcaggagactggacagcagcgctactggaggcctttggggcagagggacaggccctccaggagccctggagcctgccaaggctggcagtggacgggccctttggaactgccctgacagatgtatttcactacccagtgtgtgtgtgcgttgccgcggggatcggagtcactcccttcgctgctcttctgaaatctatatggtacaaatgcagtgaggcacagaccccactgaagctgagcaaggtgtatttctactggatttgccgggatgcaagagcttttgagtggtttgctgatctcttactctccctggaaacacggatgagtgagcaggggaaaactcactttctgagttatcatatatttcttaccggctgggatgaaaatcaggctcttcacatagctttacactgggacgaaaatactgacgtgattacaggcttaaagcagaagaccttctatgggaggcccaactggaacaatgagttcaagcagattgcctacaatcaccccagcagcagtattggcgtgttcttctgtggacctaaagctctctcgaggacacttcaaaagatgtgccacttgtattcatcagctgaccccagaggtgttcatttctattacaacaaggagagcttctagactttggaggtcaagtccaggcattgtgttttcaatcaagttattgattccaaagaactccaccaggaattcctgtgacggcctgttgatatgagctcccagttgggaactggtgaataataattaactattgtgaacagtacactataccatacttccttagcttataaataacatgtcatatacaacagaacaaaaacatttactgaaattaaaatatattatgtttctcca

SEQ ID NO: 1016 - DNA, 306 bp, Homo sapiens
ggaacatttaaaaacatatttattcaggacacagaaatgtctaaattataattatattctgatataattctaaatacaatcataaaattacctgtaataaaaaataatttaattgtacatttaaaaatgaagtgtataattggattcgtttgtaatacaaaggataaatgcttgaggtgatgaataactcatttactctgatgtgattacatgttgcatgtctgtatcaaagtaacccatctatgccatgaatgtatacacataccatgtacccacataaatttttaaaaataaatttaaatataa

SEQ ID NO: 1017 - DNA, 388 bp, Homo sapiens
ttttttttttccattttgcacaattgctttattttttttagaacaaaatgatacataaataacctagaaaatattctcagtaaaaacttgattctttaatgtcagctttgttggaaaatttctcttactaagatgggaattatatttaacaaaactaataaccctttgatcctatttgtttttgactagtttcctattactactattactgcacctaattaatctggtgacagctatggcatactaaattccctaaggcaattaactaagagattcagaaatctcttcagtgattgctgatttaatggaatgcccttgaactctggagggatgctgcccctgtgagttcacacccacactgtggccaagaggaagcagcagggcctga

SEQ ID NO: 1018 - DNA, 258 bp, Homo sapiens
tttattcctcaaagatttaatacgatgtactatgtgccacggactctactgggcactggactcacacacgaatatgtcccatcactttcacatgtgcacatacccacttcacagtcacccaggaaggcatcagctcagccacccacgcaaggtcatacagacaccgaagggtgaagagagtgggttaagaggctgttgtgattatttaaatgcatgtaacagaacaggcctgcagtggccacccaataaatgtccgcc

SEQ ID NO: 1019 - DNA, 418 bp, Homo sapiens
  misc_feature (295)..(295): n is a, c, g or t.
aaaattttctttttaattctcagcaagtcaatgtacttctacagaagggtgcgcccttacagatggagcaatggttgagtgcacacctggacaagggaggggaaagggttcttatccctgatgcacatggcccctgctgctgtgtcattcccctattggctagggttagaccacacaggccaaactaactccaactggctaatttaaagagagtgacagggtgagtggtttggcgggaacaatggttatggcagagcatggaaatcggaatgagtcaggatggagcaggtaatcngaaaaaggttgctttatgaggaagttaagtttacaagtagaaggcaaagaatttgaacatactgacattactggattctttaaagagaaatttagaactcatatctaacacactgatggctat

SEQ ID NO: 1020 - DNA, 470 bp, Homo sapiens
  misc_feature (363)..(363): n is a, c, g or t.
  misc_feature (395)..(395): n is a, c, g or t.
  misc_feature (423)..(423): n is a, c, g or t.
  misc_feature (439)..(439): n is a, c, g or t.
  misc_feature (447)..(447): n is a, c, g or t.
  misc_feature (457)..(457): n is a, c, g or t.
ttttctttatattcttttatcgaattcatatcttctcatttatgccagtaatgttctcacccataaactctaccctaaggtcaaaatgtttccttcctcctcttttaaataactgtcaatatgggctctcccaataaacaaaccaccgccaaaaaaagaacaacaaaaagcctgtatctgggatgctatgtgagaaataattacccttcacaaaccctatcttcagatatttctgtattttaaggccacaccaacatagggtggatgtatttgtgtgtgttatgtttttccaccttggaaatatttttagggaggttgggatatattatccttaaatttcattatcggagtgaggttaggggnattaaatacattggtatttttaaatggacccnaggtggattccccaaacaatccttaatnctattggggggggggncagggggncccgggggtnttcttttaggggg

SEQ ID NO: 1021 - DNA, 303 bp, Homo sapiens
gcgtggtcgcggccgaggtacttttttttttttttttttttttggtgtcatagaaacagagagcagaacagtggttatcagagactggggagggcagttgggaggggaggatgaggagaggctggtcaacaggcagaaagttacaataaggtgggagaaataagttctggtgttctgttgcacagtagggtgactctggtaaatggtaaggtattgcatgctacaaaataactagaagagaggcttttgaatgttctcaccacaaagaaatgagaaatgcatgaggtgatggatacggtaatt

SEQ ID NO: 1022 - DNA, 400 bp, Homo sapiens
ttttttttttttttttaaaccccagaacattttattagaaacggggagccagataatctaaaataaccatacataaatattaaccaagctaattttcaaaaaatccataagggagagtggagcaaataagaaagggaatatactgactacagataacagttgaaacctttaaattaaaaaaaaaagtacacaaaaaccagataaataacaaatgacgcacaagttttttaccattttttgcatataatcttccacctgttaccaaaacatacaatacgcagacttcgtatactgattttgagagcaaaacacaaaaataagccacacaacttatcagtaacctgtaagttacacaatcctataaaacaggagaaaaattaagccaaaaatttactcttgg

SEQ ID NO: 1023 - DNA, 461 bp, Homo sapiens
  misc_feature (407)..(407): n is a, c, g or t.
  misc_feature (461)..(461): n is a, c, g or t.
ttttttttttggcttacaaacaacagacatttatttatttctcccagttctggaggctggaagtctgagatctgggtgccatcatggctgggttctggtgagggcctgcttctcggttcatgggcagctgatttcttgctgcatcctcaagcattgaaggggtgaaggagctctctggggccacctttcatgagggcactaatcccatcatttgggccccatcctcatgatatgatctaaacctaatcacctcccaaaggccccacctccaaataccatcacattggggattaggtttcaacatataaaatctgggggaacataaacattgagtctattgcacacgagtttattagttcccagtataacatcccaaggttgctggaggcctattatataagggatcnaaagttctcgttcttgtggtgaatgatccgaatttgaatctccactgtttggan

SEQ ID NO: 1024 - DNA, 364 bp, Homo sapiens
ctaagacagagtcttgctctgttgcctacgctggagtgcactggtgagatctcggctcactgcaacctccgcctcctgggttcaagcatttctcctgcctcagtctccctagtagctgggactacaggcgtgcaccaccacgcccagctaatttttgtatttttagtagagatggggttttgccatgctggccaggctggtctcgaactcctgacctcaggtgatccacctgcctcggcctcccaaagtgcgggtattaccggcatgagttaccacgccttgccatattttgatgttctgatccccaacttctccagcatgaccagctaatatgttttcatatgtcctctccaaagctcaagtt

SEQ ID NO: 1025 - DNA, 393 bp, Homo sapiens
  misc_feature (318)..(318): n is a, c, g or t.
tttgcagttgggaatattttattagtgagttcactttgactgtaaatggcaaaaacttaccagagctagcttaagaaaatggggaatttagtacaagaatatgacgatgtttcaaggaaccacagggcagaggttcaatcaggccttggcagggagcttttgtcagaagagaatggagcatcatcagttagaagagaaaaagtcttcagaggtaaaggcacccacatgtgtgtaagtcaaggagatgatgaaaaccaggcacacatggactaaagagtgtcatccccgccatcttgaattctctcttgatgttcacancatagccttgttatgagttttctacttttagattcaacccaggaggctttccttatttcttcttacataagactc

SEQ ID NO: 1026 - DNA, 275 bp, Homo sapiens
tttaatttacagtttcttctgggcctttcaacattatcaatgtctccctttctggcggcacgaatgaagaaattttggaatccataagagccaaaaagggagacattgataatgttaaaagccccacgggggaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgag

SEQ ID NO: 1027 - DNA, 333 bp, Homo sapiens
  misc_feature (230)..(230): n is a, c, g or t.
  misc_feature (319)..(319): n is a, c, g or t.
  misc_feature (329)..(329): n is a, c, g or t.
ttttttttggcatgactaacaatttattcaatgtgtgtgtactgctatgtgtcctcatgcatgagctatgtcaacaaggacaatctactgataagagaaaatgaaaatgtacaagttgtaggagactaaacatggttttaacttagtacacatttttctgaaatgtcccccgtgattaagttgtgaacaaatgaacatgccacatgtcaacaaactgaacaaacatgggnttgttagtgacttagaggtggagggagggctagagagaggctagctgtgttggtctgccaatctcctgtgtcccacactggctacaaanttacaaccantggg

SEQ ID NO: 1028 - DNA, 485 bp, Homo sapiens
  misc_feature (471)..(471): n is a, c, g or t.
tttttttttttttttttttttttttttttttacagggtaatctggaatattattttcaaacctttccatggggcctgggtactggactcttttcaaaggaacatattggcttgggtccttccattcacaggacacagggaaacaaatcttttctgggctgcctggttgagccggatgttctccccttccttggtttggggggtctgaagcagttttcctgtcacctggcagccaatgaggaggcttttgcgcatattggcaactcggatcatgaggcagggcttgccattgtgggaggccacaactgcatgctggctgaaacgaatggtctcagcccgcttcttgggccgggcaatcttcgccaggaaggtacctgtgatgaaaatttccaggatggtggtgagcaccagctgggcaataagaagcacaatggccagtggacattcctcactgatgtagcggaagccatanccaatggtggtttg

SEQ ID NO: 1029 - DNA, 482 bp, Homo sapiens
  misc_feature (368)..(368): n is a, c, g or t.
  misc_feature (392)..(392): n is a, c, g or t.
  misc_feature (411)..(411): n is a, c, g or t.
  misc_feature (441)..(441): n is a, c, g or t.
  misc_feature (446)..(446): n is a, c, g or t.
  misc_feature (453)..(453): n is a, c, g or t.
  misc_feature (481)..(481): n is a, c, g or t.
actcgccagtttcattattattaaagaatccatttgaatgtcagctcaacacagcctcctataccgaggcattgtgaaccgcatctccccagcttctccaggcttttccaagaatcagggacactgtagcctgttggtctcagtgtatgacagacacggaggaagcacatctttagctgatacttaaacagagaccctgagcgcacatacacccgcgcacacatgcatggagcttcaccttctctgtcattctgcagtgaccaggagagcaagagctcccacctcccttcaaaacactgtgcccatcccgggcactaaggcctctttaaagcacggcacctccacgagggaggggccacagccacatnacactccacctggcaggtggacangcgttaaaattgtgggacnataggaaggacaagggtggcccggccaggnccaanggccttntggcggtgacagggacagaagccctctna

SEQ ID NO: 1030 - DNA, 424 bp, Homo sapiens
cttaccaagacgtaataatgtctgaaaagtttcagctttgctaagttaatagcagctagagagaagaaagaacaaaatgaagagctcgttaacttctcatttttaaaagtaagcctcattcagataccttctcagtcaagaggccacctctaatgcagatgaggaccactcagaggcacatccatctatctggaatcaagtccgctgggcggtctctcctccaatcaccaggaaaaaatgtgggagcagcacagccccagtgagccccatgagctggagttggcttgcacaggcgattcccgccccagggtcagcagctgtaacctggctatggtgggagtatactgacatcacaggaattggcagatgctacaaatcaggaattttttccccccagagagccagcattaaacatttcagctct

SEQ ID NO: 1031 - DNA, 459 bp, Homo sapiens
  misc_feature (459)..(459): n is a, c, g or t.
tcggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctgtgtccgttgagaacattattttaacaagaagaacaccaacagtagcatgaaatataatactgttttataattctaaagctggctgttaatttatgaagtacataataatctaatgtaaactgcn

SEQ ID NO: 1032 - DNA, 419 bp, Homo sapiens
tttttattcaaattttattggaagtttacaaatgtattacagacatcagtaaaacatcatatccattttacagggcacggatctcaagcaaagtgttcagaacagtctctggcagagccacaccaaaggcctgttgcagaccttcttaacaaatagcttgacactcaacacagaacacagactctggcctgcctcaccttcccaggccctttgaggttttgtttatgcacttgaaatgaaagcaggagatggacaaagcaatcctgtggaggaaagaatgagtttaggagaggaaaacctgccgaagtcctaatttgctaaaaaaaaattaattaaaaaatggaggactcatagtccttacaatgttaagtcagggtctatgatagaatcatgacactttatggaaagatatgaaaatc

SEQ ID NO: 1033 - DNA, 275 bp, Homo sapiens
aaactgaacttctttattaagtgccaagggtccaggcgggcgctgccccctgcggccccctccgccgaggcctgtgcgtggcggggttcccaggagcgggagtccgtgcggcctgggggcggccccctccccgcatcgcagcggggcgtgcaaagcgtctgcggctgtagtgtgggcgctcacttcacgtgctcggcggcgtgcgaggagcagtaatacttcttgtgggcgatgaaggtggacaggctgctgaactttgtgttgcaaagaccgca

SEQ ID NO: 1034 - DNA, 249 bp, Homo sapiens
ggctgttacatcaatttttattaaactaagagactaagatggctaggcttctactttatcaaacatgggacaattgaagttcactttagtcttctgtgagaggcttgcattttttaaagaaaaaaggacaaagtcaggagagggacaattgcaaacgtcgtttttcaggaattctcattggtctacagaaataacagtctggcgattagattgttgtttgaaccacagggtatgagctgtggtgtccag

SEQ ID NO: 1035 - DNA, 389 bp, Homo sapiens
  misc_feature (248)..(248): n is a, c, g or t.
  misc_feature (378)..(378): n is a, c, g or t.
  misc_feature (381)..(381): n is a, c, g or t.
ttttttttttttttttttttttttttttttttttttttttttttccaaaaaaaaagggctttatcacccggcctcacccccccccccggcctccccaggagtagggggtcaaccccccctgttggcggccccccccccaggggtagggcccctcattgccggggttggcaatgatgctcagggccccctcccccagggccaggtacccggggtaggaaaactccaggggctcctggcccttgacccanaccactttccctttcttggggaggatcttctggccgaagggaaaggtcacgttcctgccctcggccaccacccctggttttggtcctggggggcgggggggggtgggccacccgtgggaaagggaattcntancaaaattc

SEQ ID NO: 1036 - DNA, 420 bp, Homo sapiens
ttttcataggcaaacattattattttatttattcccaaatggtgcaagtattttagagtatgccacatagttttctatatgccagcagtctttttcaaaaatacgtatacattccacttcagtccccctcatactgtaaatttgtagacaacatgcttgttacattgctctcttcctgcaatacagtccttatttcccctccatccatcttgaaagtattcctttaatttctccagtaacactatgggtttgccatttcgggcatcaatgacattcagggatgtggccatagacttctcgcagcaggagtgggaatgtctcgaccatgttcagaagaccttgtattgggatgtgatgatggagaactgtagtaacttggtatgttttctgcctcagacaatttaggataactttgaatct

SEQ ID NO: 1037 - DNA, 403 bp, Homo sapiens
  misc_feature (382)..(382): n is a, c, g or t.
ttttaaatcattcagtttaaggtcactagactttagatgagtgaccctgcaggtttataaggcattctgctcagcagtcttgtaaatagtcctatatgaaagagccatgctactgttggacttggtcccactctggtcaaccttgataacgtcatacgtggcttatggactggatagcactggattccgccgcagccctggccatactgtgccacacgttggaagaactgtgggatgtagaatggagggactccttgtcagacagtgacagcatcatagcatatgcctgcgatttggactttctgtgtaacggctgcttaagttcccctggcacatgggaagtactaaaagaagacagctccagcttcagaatattggatancctccaattttccccaatttg

SEQ ID NO: 1038 - DNA, 446 bp, Homo sapiens
acaatgttttatatttattttattgaaattgaacatctcttttacaaatgctaataaatgaatctattcattctctcatttattcaaccaatgttaattgagcacttactattacatgccacttaactagtttcactcagtttaatgaagcatttctataaatccttgagcacagacgtttctatgtatattgcaagctgtgtttgacaattgagtagcaattgctgatgctggaaaaaaactaatgttgcaaatatttcttgagtaattatatcagttgtttttggggtttggcttaggatgtgggttcagaagtctgaagcctttcctggttctcttaatcttcaagagaaatgtgacctgctgctgagttgagataaataatcctgtgtccacagcaaacagaatcaccaccaacaatgggataaaaaattgtagccagtact

SEQ ID NO: 1039 - DNA, 470 bp, Homo sapiens
  misc_feature (200)..(200): n is a, c, g or t.
  misc_feature (371)..(371): n is a, c, g or t.
  misc_feature (431)..(431): n is a, c, g or t.
  misc_feature (445)..(445): n is a, c, g or t.
  misc_feature (455)..(455): n is a, c, g or t.
  misc_feature (467)..(467): n is a, c, g or t.
tttttttttcctcgaatgacaatcagttttattgcatgagttatggtgtccaaatgagttaatttgcttttttcaccgtctgagtcaaaataggccacctgcaggcctcatgcaaaatgtagaaactggatagatgatttaagcctcaaaaacgcaagtgattttttggggtgcacgcaggagagggcggatctggggtntggtcagcagatgaccagccgtggccttgaaggcagtttccagtctctgcagctgcgggatgagggtgaagccccccatttgctctgctcagcctctctgttgagtatttaagaaatcctgattctccgtgttctgccagggaggatactgcagaaggagtgggactggtntggccattatttcagcatcttcaccatgttacgggccttgtaatctgtagccgatttttncataataatttccngggggccganccctgatatcanagt

SEQ ID NO: 1040 - DNA, 393 bp, Homo sapiens
cttcaccttcatgtcctcctgcagtttggccgactcttcctccccaatgtatctgctgaaaaccacaggatgggcctcacccatgaaatcgtgctcggcttcctctatgtccaccacatccgagtcagaatcctgcctgaggagagtccacggctctgaatcgtgggagttggggctttttgaacaactaacatataaccttccctcggtgtcttcatcggccctgcctacatgaaggaagaagccatccgtggatggtccctgggggaacggatcgaatccgccaagggcagacgaccacagacctctcctgcggtttccactgacagtggtcctgtctcggtggggtcgatgcccatggggaattctgagcatggaatcggggtaaaagta

SEQ ID NO: 1041 - DNA, 450 bp, Homo sapiens
ttttgccatttcaatatttatttggttataaatgcccggataagtagctctcggccccagggcaccatgacctttgaagcacttggtgctcggtgttggaaagcaaaccagagaagatggtcagtgacgtcttcatgtggagaaaagagaaggggaggatgcatctgaggcacttctggaaagaaagcaggacgggaaaaagagagctccacgtcttgaatataatcagggactcgggactccgcagcatgacctctacaggtgacctcacctgctagtgaagactgcgggaggtcagtgtttagggaggaaagaaaatcaacaggaaatgtggaatacgcgtttcttccactctgttctccaggattttcattccttggccagttgcttccgggaatttattcccttgtctggaaataccatctctctgttgttcttattaaagattct

SEQ ID NO: 1042 - DNA, 262 bp, Homo sapiens
  misc_feature (31)..(31): n is a, c, g or t.
  misc_feature (79)..(79): n is a, c, g or t.
  misc_feature (119)..(119): n is a, c, g or t.
  misc_feature (160)..(160): n is a, c, g or t.
tataataactttaaggaaaagatacatcggncaacacccgcacaacctgccttctcaccacaccccacaggccgatttnaaccctggacgaagggcaccgagcgctgggcttccctggnccctgcatctctgtcgtgtgtggagtgccatccccaagggnggtctgaactgtccggggacacggctgtcagaggacacttgctctaccgaacaggacaccttgagctgagcagcccttcccctcccgggagtggcagagcgg

SEQ ID NO: 1043 - DNA, 402 bp, Homo sapiens
tttttgtaattacaattatttttatttttttgtttctctacgtaagtacaatttataaatacagatatgtatttgtagatattaatttcacatttacatataacaatagctaccaattcattccttaaactatatttttttttttttgcagcacacatctagttactaggaatgcagcaatgggggaaaaatatgtccccactctcccaagctttctggtgcagaggaccagaagaggacctcaaaggtgtcttgtcttgtcttttctttgagatggagatttgctcttgttgcccaggctggagtgcaatgacacaatctcggtggctcactgcaagctccacctcccaggttcaagctattctcctgcctcagcctcctgagtagccgggaccacaggca

SEQ ID NO: 1044 - DNA, 5449 bp, Homo sapiens
gcgccgggggccgccgcgcccgccgcccgctgcctgcgccgccggccgggcatgagttagtcgcagacatggacaccaaacatttcctgccgctcgatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcacccccctgttttctctctgccttggtgttctggtttcagactcccgactccccgttcagaccagagtgccccggcccctccccagcctgagtcttctccttgctctgcggggtgggctgaggcttgtccttgtttcctgcagggctggccctggctcgggcagggtggggcatcaccacctcactggccttgctggaggcacagggctctgcggacctgcagccatctgtgaggcccgcggggatgggaggggaggagggtggcctgttggtttccctcagagggggcaggtggcctggagagagaggggctcaggaactgggagcctcgtgggtggggcagatgctccgcggcctggagtggctctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggccctccctttggcctgagtacttttcccgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggcctcaggtgccagggtttgatggacagtagcattagaattgtggaaaaggaacacgcaaagggagaagtgtgagaggagaaacaaaatatgagcgtttaaaatacatcgccattcagttcgttaaaaaaaaaaaaaaaaaaaaaaaaa

SEQ ID NO: 1045 - DNA, 406 bp, Homo sapiens
  misc_feature (295)..(295): n is a, c, g or t.
  misc_feature (339)..(339): n is a, c, g or t.
  misc_feature (398)..(398): n is a, c, g or t.
agaaacaactagtgtattgatttggggaggagagaaggggtgcagatgggaaatggggaggcaagggctctttagcgtttgccaaaaccactgccacacccctccaccccctcttgccttcctcctccacggtgggtgccagcaggtctcccctttccagtgacctccctctccctcctcccagcaccccacttggcttcaacctccagtgactgcacagagcccacccagggtctaaagctagggaaggcagctcaaactcacctttcttctcccttcttccacctcccacctnattcccatctcttgtctaaataaaatacagaaaagcaagcgcantggttacctgggagaatggactcaccccggggctgggggcaggggtggggactgggggnggggcagg

SEQ ID NO: 1046 - DNA, 8923 bp, Homo sapiens
agctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaaggcaccattgtccagcagctgagtttcccagggaccttggagatagccgcagccctcatttatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctacgccgggaagacctgcggcctgtgtgggaattacaatggcaaccagggcgacgacttccttaccccctctgggctggcagagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgcccccccacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgcgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgctgcatgttctgctcttgtgcccttctgagcccacaat

SEQ ID NO: 1047 - DNA, 489 bp, Homo sapiens
tccctgaatgaactatagcaatattctggccattcactattttgtaaatatcctaaaatccggtatgaagaagaacttccgtgtgcaggagggtattgtcatcactggcaagaaggaattaaagtacagaaactataaaccaattcagtggcaaccaaaacaatacacaaaaaagacattccctcaatccccaatacttcccttttataagtaaaactcctaattgagtgccccattcatgatacaatcaaacacgcagaactatggccaactagaagggaccgttcaagacattctgaaatgaaactcccaccgtaatcacaggtgagtctaaatggttttaaaatcctggagaaatcctttgcttttatttaaggacagcaagcccagcaacatccaggaaacaagaaccataaacccatccttccccaccgaggaaagtgacactgagggaggcactggtggtggaatggcagcccatgcagtggc

SEQ ID NO: 1048 - DNA, 437 bp, Homo sapiens
  misc_feature (350)..(350): n is a, c, g or t.
  misc_feature (364)..(364): n is a, c, g or t.
  misc_feature (400)..(400): n is a, c, g or t.
  misc_feature (411)..(411): n is a, c, g or t.
  misc_feature (433)..(433): n is a, c, g or t.
ttttttttttaatcggaattaagtaacatttattttacataaaacaatttccagagaatacatttaaaaaccatctagatactgattttttagcattacaaaaaattgagaggcacaattgaagtattcaaataaattgtgaggggtggaggtggggactatgctcactatctatgttgttccttagtcacttaaaggctctgcgtgcaagagtctttacatgaggcagtagtgcactttcatttagtaggaataaatcacataaaatatatacttttatacagaaagtgttattgtgttgtcattttcaattacttataaaaacttcatttgaattgcacaaaagttcncctttaaaattggntaactcccagaagaccagggccttagaactggtccnaaataattccnttaccaataattaggggttccnattt

SEQ ID NO: 1049 - DNA, 524 bp, Homo sapiens
  misc_feature (10)..(11): n is a, c, g or t.
  misc_feature (24)..(24): n is a, c, g or t.
  misc_feature (26)..(26): n is a, c, g or t.
  misc_feature (31)..(31): n is a, c, g or t.
  misc_feature (33)..(35): n is a, c, g or t.
  misc_feature (38)..(38): n is a, c, g or t.
  misc_feature (48)..(48): n is a, c, g or t.
  misc_feature (426)..(426): n is a, c, g or t.
  misc_feature (442)..(442): n is a, c, g or t.
  misc_feature (460)..(460): n is a, c, g or t.
  misc_feature (468)..(468): n is a, c, g or t.
  misc_feature (505)..(505): n is a, c, g or t.
  misc_feature (513)..(513): n is a, c, g or t.
cggggctggnncgcctgcagggantntaggntnnnagnttgcccactnactacgggaaacacggaacgccacagaagtatgatcccactttcaaaggacccatttacaatagcctggactcatggagaccctcgaaaggtgatctaccccactgatagccggggcaggttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggggttcaagaacaataaaggagtggctgaggtgttttcgagatgggtgantgccctgctgttcctnattccccagcaaaccttnggcccggngatgtttccccgttattccaaggttacaagggtgtcntgatggtngggaatgagga

SEQ ID NO: 1050 - DNA, 453 bp, Homo sapiens
gcagcgcgtacgcccgtgcagttctacaaggtgtgcgtgacgtggtgagcgagaagtgccgtatcgacacggagatcctgccctccctgttcatgcgctgcaccaccgacctcaaccgcaaggacaagttccccgccatcacccacctcaagttcctggcccgggacatgtcggagcaggtgcttttgtgcgcgtccagccagaccagcagcatcgtggagtgctggtccctgcgcaaggagggactccccgtgaacaacttcttccagcagatctcccccgtggttggcgacaaacagcccacaattctcaaatggcggatcctatcggccaccaacgatctggaccgtgtgtcggccgtggcgcttgccaagctgcccatctcgctcaccaacaccgacctcaaggtggccagcgacacacagttctaccctggcctcgggctggccctgg

SEQ ID NO: 1051 - DNA, 485 bp, Homo sapiens
  misc_feature (279)..(279): n is a, c, g or t.
  misc_feature (425)..(425): n is a, c, g or t.
  misc_feature (461)..(461): n is a, c, g or t.
  misc_feature (480)..(480): n is a, c, g or t.
tttttttttttttttgagacaaagtctcgctctgtcgcccaggctggagtgcagtggtgcgatctcagctcactgcaacctctgcctcccgaagttcaagcgatttttctgcctcagcttcctgagtagctggggctacaggcatgcaccaccatgcctggctaatttttgtatttttagtagagacagggtttcgccatgttggccaggctggtctcgaactcctgacctcagttgatccacccacctcggcctcccaaaatgttgggatttcgggtntgagccactgcgttccagcctggggttgttagttttatcatcaccccagcacagtacgagggaggctaacacgaaatcctgtctctggggcccagggagctgcagggaccaggggtgagtaccagtgatgctctgaaatttaagantgggcaccctggggttggcagaggcaaaagctggtnggggacagggattgcttgnttttg

SEQ ID NO: 1052 - DNA, 3639 bp, Homo sapiens
aagtcttctgaattgtttttctggacttccaaatctcaagtgataagaccagcagaagcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaaaggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcgccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacgacatgtgtaacacttttcagtctgtggatatctgatacattaagatttctttttataagtattcattttgaatgtgcatatagtcatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatat

SEQ ID NO: 1053 - DNA, 222 bp, Homo sapiens
  misc_feature (212)..(212): n is a, c, g or t.
atattttaatggttgaaacctgtctttatgaggcgattatgacagcaaaaaatattataatgaataacaatgcatagtctacgctttgtaatatttcatacaataattcctttatcatttacatctcttaatgctagaaaagcattctgaagatgccaagcgtaagttgcaactgaggtaaaaaaaaaaaagcaaaatttactcaatttccnggagagggtg

SEQ ID NO: 1054 - DNA, 460 bp, Homo sapiens
  misc_feature (424)..(424): n is a, c, g or t.
  misc_feature (452)..(452): n is a, c, g or t.
tttttttttttaataatttacccaatgtttaattgagtaatgaattcatttaatataaactttagtatagcagaatactacaggttacccacatttaaccctaaaaacaaacaaatgacaggcacttcagtgaaataacaagcccatgttcaaatataaaatgctaaaagtgagaaagaaattatgaaaatatatacctttaatttgcagacatataaacacttttggtacagtacagatgcatgatgccaaaaagtaaaatgatccagtttaagctaacacattccttgtttatacagattattttgctatagctctcatataaaataatatttccagctcccacaatgaattgaaagtgataaatcactggatgaaataagctttcttcattgcaagagattcagtaaaagctaaattatcnaagaaatctgctgcagggcttaccaatnaactgttt

SEQ ID NO: 1055 - DNA, 295 bp, Homo sapiens
tttttacatgtggtagcgcatttaatattcacagcaacacaaatgggaagtaatattcttatcgccattttacaaataagaagaccaaggcccagaagggttgaatatcttgctcaagatcacacacattttgccaccccccattccaagtcccataggcaactcagactcagcatgtccatgatgtaacttatcttcctctccaaaccatttcctcacttgtgccctactctcagtggggacatctccaatccccaggcccaagctggaaaccggaagccatttccctcgtgcc

SEQ ID NO: 1056 - DNA, 485 bp, Homo sapiens
  misc_feature (425)..(425): n is a, c, g or t.
aaatgttagagtaaatttattattgaagaaagaaaagttttcaatcaatgtgtagcataagtgtacagcattttttagagtctacagtagtgtatagtaatgtcctaggcctcatactccctccactcactcactcacccagagcaacttccagtcctgcaagctccattcatggtggaccatttttaatctttataacatttttactgtaatttttctatgtttagatacaccaataccattgtgttacaatggcctatagtattcagtacagtaacatgttgtacagctttgtagcctaggagcaataggctgtaccatctagcctaggtgtgtagcaggctgtactatgcaggtttgttcacacgacgatgaaatctaatgatgaatttcccagaatgtatccctgttgttaagggatacanttgttaagcggtgtgtgactatatgtatatatatatatatatatatatgcactatataga

SEQ ID NO: 1057 - DNA, 530 bp, Homo sapiens
tttctcaggtatgtttttattagcagcatgagaacagactaatacaacatgtgtccatcaataaatgaaagtataaaaaaaagtattatacatatgtaatggaatactattcagccattaaaaaactatgaaattatgtattttacaacaagatggatgaaactagagatcattatcttaagtgaaacaagccaggcacagaaagacaaatattgcatgttctcactcataaatgggtgaagattatgggagtcaggcagcaggtcgggatagccgctgagctgaccagtgactcatgtggctgtaatcactaggacaacagccttgtatctggctgaaaggctggtgaagccactgaggatggatgacagacgtattgcctgctacaactgcagcagaggtggggggctcaaagatggcaaatgtgatctacttttgaatttttaacacacactaaattataaatttttctaatgcaatctacaattattcagcattttcacctttctagtcaagtcaagagctttacc

SEQ ID NO: 1058 - DNA, 178 bp, Homo sapiens
gctttttacaataaactctatattgtgcacatggagacctggagatgtgccgacttcctgttcccaaagccaatcttccccgccaaggagactgaggatttcagggctcagagttaccgcaggaatcgagttgacaccagggagagaggggggaggaggggaatcggaggggatgggt

SEQ ID NO: 1059 - DNA, 459 bp, Homo sapiens
catacttttattcaagattcgtcttcccatgagacactctgggctgtcaggctgtaattagactttctcccaggctgtgtggagtgagagacagagccagattagccccctgtaaacaaatttggtcagttctctcctcaccagccttgttctggttgagcggatttcagcagctcctgggtgaatgttaatgccccccacgtacacagttgcaagaaaaacaataactgtgcatttgtgcctccatttcttgagaacgctctgggtttcacttttcacaggtctttgtgatgtagcactaggcagtggggggtggcatggcagggaagcagtgcaaagagactggaaaaaccttaaggcaggaggtagggcacctgggtttcaaggcaagctcagccactaattgtctttgtaaccttgcaaaagtcactttagctctctgagccttgggtatctcgc

SEQ ID NO: 1060 - DNA, 535 bp, Homo sapiens
ttttttagcgacttaaaacaaaacacatttattctcttacagttctagaggtcagaaattcaaaattagtttcactgggctaaaatcagtgtgttggcagggcacacttcctccagaggttctaagggaaaacagtttccttgccttttccagcttccaaagctacgttcgttgcatttttggccttctcttccacctccaaagccagcagtgtagcatcttgctgcagtagtcacattgcctccttctcctgtgtccaatctctctctctggcccccactcataaggacacttgggattgcatttagggggtccacccagataatctaggataatcccctcatctcaagatccttaatttaattacatgtgcaaagtccattatgtcatataatattcacaggttacaggggttataaaggggtatattttgggggccactatttagcttaccaccaaggaagcaagctccaaaagtttggaagaaacacagttcagatccctggtccacatgaaagaagtgtcagattaggag

SEQ ID NO: 1061 - DNA, 634 bp, Homo sapiens
  misc_feature (271)..(271): n is a, c, g or t.
  misc_feature (459)..(459): n is a, c, g or t.
  misc_feature (487)..(488): n is a, c, g or t.
  misc_feature (499)..(499): n is a, c, g or t.
  misc_feature (539)..(539): n is a, c, g or t.
  misc_feature (582)..(582): n is a, c, g or t.
  misc_feature (601)..(601): n is a, c, g or t.
ttttttttttttttttggtttaaacaaagaagtttattttctcacagttctggaggttagaagtctgagatgaggatatcaccagcatggttaggttctggtgaggactctctggcttacagctggctgctttctcaccatgtcttcacatggcccaaagagacagaacaagctctctggtgtcttttcttgtaaggacaataatcccatcacgaagtccccaacctcttcacctcattcaaacacacttaccttccaaaaggcccatctnccaataccaccacgttggaggttagggcttcaacatacgagttttaaggtggcacagtcagtctattaacttcctgtccatatattagttatgtattaggcattatgtattacctaatacatagctaatctgtattagtcagggttttccagagaaacaaacacatacacacatcctgagagagatangagagagagactcatatagaaggagctnncaaatattttnttttgtgtgtgtgtgagacggtttcactcttgttgcccangcttgggagtgcatggcacgatgtcggctcacttgcacctctngtctgcggttcaaacaatntcctacctagcctccaagtagctggattacagg

SEQ ID NO: 1062 - DNA, 554 bp, Homo sapiens
aagggggaatttgattgctatttggtattaaagagttttaagattcaaccacctggtacaacagcaggctctgaaggggaagccagacagggaacctagaggtacaagcaatgtctccccagctgtcagcctcaatgagaatcaccacccataaataagctaattattgacaagattataatctttcgaatatgttcaaaacaggtctgactagtgactatgagaatggagctatttagagttgatttaaaagaaaacactttattgttcagcaattaaaagttagccaaatatgtatttttctccataatttattgtgatgttatcaacatcaagtaaaatgctcattttcatcatttgcttctgttcatgttttcttgaacacgtcttcaattttccttccaaaatgctgcatgccacacctcaatacatgccgcgtgatcctagtagttttttcacaaccttctacaagtttttgggaaaacatctgttatgatgactttcatacaccttcacctcaaaggctttcttgcacctcggcagggcccagctcg

SEQ ID NO: 1063 - DNA, 2644 bp, Homo sapiens
gaccgcggcagctcagcctcccgccgattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaactcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgcttttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagccaaaaaaaaaaaaaaaaa

SEQ ID NO: 1064 - DNA, 581 bp, Homo sapiens
ttattttaaattcctttaatgaaacctcaccctcaaacttgatacatcagaagatttgcttggactaaaagtggaatttccatcttaaccacatggctccgaggttctgctctcaggatgaattgggctccatgtcattttgtttgtcactttcttctcggaccagcgcagtggcttcaccacagtgggcactgtggttggattccgtaccttggaacctttgagcatgatggcccctgctcctgggattccctccgcttcttctctctccgatgaggttgtgtactaatgtcagctgtacacgttgtcttttcagcatgttacctcctctcagaagcctgcccccacgctgtgcaatggtcgctgtgcagatctctgttacggcgtcattgcctgcattctacttagctctcgtctgtctcccctccagactgtgcccccagggcttccaggtctagcctcatttctaatagtttgttgccacgatgtcacgaattagagccctgtctgttagcccacagggctccagcctcaccctctcccacagctcccgtggccctcctagcagccttcagagcttc

SEQ ID NO: 1065 - DNA, 432 bp, Homo sapiens
tttttttaagaatggaactctactttattaaggaatactgagcatccatcctataagaactaagcccattctgagcacaggccccatgtgtaggaggaggcagtttcccatttcctggaaatgccttatctcctcttccttcacagcaaaccccttcacctgccgtcatgcccgtcttcactctccaggtgcgaggatcccgagaacaaagccctggtagcatcctgagatcaagggcgacacctgtaggacaaactcctgattcaagcccaaatatctccagggaacagatatgtcctcaaagttaacacttctttaaaaataatgttcttggccgggtgcgctggctcacgcctgtaatcccagcacttcgggaggccaaggcgggcagatcacgaggacaggagatcgaaaccatcctggctaacgcgg

SEQ ID NO: 1066 - DNA, 441 bp, Homo sapiens
gcaaaattccactttatttattcattcctcctccacattaaccttattaaaacccaaggagaagaagggggggaagggaaaaaataacctgaagaccccaattagggttggttccctttggaaaaaaggtccaaagcccaaagattggaaggggtcaagcttgaacttaagaaccagtgggggcacttcttccttttacccttttccctgttgaaactttttgggacgggccaacctcagcccttattggggaattccccagccttaacttttggtttctccgaatctgctttgctcaacctcaaggtgcttctgaggcttgaagtgctggccttgctttcctgctttttgacacttttcttggaatttccccattggaaggcgtttttcacctttcactgtaccttttgcctttctgggtaaaaagttatttcaccaggc

SEQ ID NO: 1067 - DNA, 453 bp, Homo sapiens
tttttgcatgaactaatttgagcttcttattcattcaaatgttgtaacaattaacagaggtgtactatttggctttttatgctagtatttatgcttgttatccaaatcatgttcacatttaagaagtcattacacattttctgatgtattttatctaacaaaagacatttcttgcttttggaagcaaatgaagacaggtttttcataccccactgagtgacgtgttccactcagtacacagagataagatctccacagttggtagttgaacaggtgaccagaagcacggaaatgcagttcttcaaactgagaaacacagatttggaagaatgcttacaattcttttaatgagtctaagtaattcatctgccttgggaagggacacagacagccagattaagtaaccttttgcatgttcacaggtcaacttggagtatgctctttactataact

SEQ ID NO: 1068 - DNA, 338 bp, Homo sapiens
  misc_feature (217)..(217): n is a, c, g or t.
  misc_feature (226)..(226): n is a, c, g or t.
aagattttctatatgcaaaatgtcatctacaaataagagtagtttcacttctttccaaccttaatgccatttctttctgtttattgcttatttgctgtggctactaaaattttcagtagaaatttgattacccctagattctgagattgtctcctatgtttttcataaaagtttcatcgttttacatttaaggctgtgatccatttactcgattttngtatcaggntcaaggttcactttttgggtcttttgggccacttttcacttttgacgtcatgttgccacaggcaacatttttgaaaagggctatcttttcaccaattaggttgggctttata

SEQ ID NO: 1069 - DNA, 383 bp, Homo sapiens
  misc_feature (369)..(369): n is a, c, g or t.
ttctgttttgctggaacttttaataaggaatctcaggttagactttccaagtctctcaagaatacaaagagaacttgtctggcttgtttcaactttgcctgcaatatctgtagactttgatgaattattcttttcttgatgtccccaatatacctgaggtctgccaggaagtgacctttcttactcatctgttgccagattctgtcacttttccagggatcccaattgtagagcaggcagggtgtcccagagatcccatctgggtcaccgaaactgtaggggcagaataataattttctccatatcctttctgtgtttccggctgggacttcctgttggtttcttagacgtctacaccggcccatagcnttgtctccgccacc

SEQ ID NO: 1070 - DNA, 432 bp, Homo sapiens
tttttaacattagaccagattattttattggtttcagcatttatgtttggatctgtcaagatcaggtcaggagacagaaaccacagaccagagattttctactgaatatttactgtaaagttaaactagctcttgaactaaaaggcttttgtagttatatactgctttgtatccaactatgttttcatttagttgcttaagacaatcatgacatattatttctcaggattcttatgattctgggctgactggaatcatctgggatgtccttctattccaaatggtccaatttatgcagctccattgccctgggagttcagctgggcatgaggatggaaaatccaaatggctcacccacatgtctagtgccttaattatggtagctgagacatctgggtgaggctcaacttcactagaagcagcatagttata

SEQ ID NO: 1071 - DNA, 292 bp, Homo sapiens
ttacttggtaacacctttttaataggtcaaagtaactgtacagttcattatattcttcctgagaataatttatatcccccaacaaactaaagggagggtatattttttcaaaattaacagaatggatggtgtaactggacatcaaaagaaaaccaaattcctgttttgcttcattctctcctgggaagacagatacaaggaagggttagttaactccagtggctgtaaaatagtcaacatggctttaatctttctttataaattatataaaaatggaaaaaggggatggttc

SEQ ID NO: 1072 - DNA, 393 bp, Homo sapiens
  misc_feature (235)..(235): n is a, c, g or t.
  misc_feature (246)..(246): n is a, c, g or t.
  misc_feature (251)..(251): n is a, c, g or t.
  misc_feature (262)..(262): n is a, c, g or t.
  misc_feature (309)..(309): n is a, c, g or t.
atcaaggtatatacacgtttatttaaaaaagtttacagttttcattatacacaactattaagaggttatagtcagaggaggcatgtgtcctgttgacagacgtgcctactagatcatcacaatgcaaggagaaaggtggaagggaggagacagggcgaggaaaaataagcgataaaaagcttcagatttcagttaggggctggcagtcccttttatcttttcaagtatcacacantatgtaccaantacantctgtaaatantggccatttcttcccaagcccacagccaagatgagtgttaggctaanttcagagccctgggctcttcctcaggatgagtgggaaaacctgcggcatgacagggccggctcccccttctcaaagggcttcct

SEQ ID NO: 1073 - DNA, 432 bp, Homo sapiens
  misc_feature (321)..(321): n is a, c, g or t.
  misc_feature (330)..(330): n is a, c, g or t.
  misc_feature (411)..(411): n is a, c, g or t.
  misc_feature (432)..(432): n is a, c, g or t.
gctatgaaaaaaagacgattgccttgctttctccaggaatcttaagaataaagccaatatttctaattctaaacttaccagagatcttcttccaaatggagaaccattttttctaatatgacttgattcgcagtccctgaattcctgcactcatttgatgattcagtcattacatgtcagattgtgaaccagacactgagcccagggcaggaagaaaaatgggctcccatggaggatacacggaggttgggcacagtggatggtgggagggaacgcagataataaatggaaaaacaactatctttattaaaataagataanaacagtcanaaataatacaaagcatataaaaccaggttaagatggataaacatggaatgccgaaaacttgctttaagaaaaggttagcanggtatttgaagctcctagctn

SEQ ID NO: 1074 - DNA, 461 bp, Homo sapiens
  misc_feature (359)..(359): n is a, c, g or t.
  misc_feature (371)..(371): n is a, c, g or t.
  misc_feature (381)..(381): n is a, c, g or t.
  misc_feature (405)..(405): n is a, c, g or t.
  misc_feature (411)..(411): n is a, c, g or t.
  misc_feature (436)..(436): n is a, c, g or t.
  misc_feature (451)..(451): n is a, c, g or t.
gatagatatcaacaaataagcactgggaatcttggactccctctttccctccaaattaagccacaattccaggcctcctttcagtttgaacactcactaaatttttgctgcttatagctcatcagggaaactcttgcagaactattcctggaactattccatgtggtgccttgggatttgagtctaatttccatgtttctctcactctcaaaactgacccctcatttatccactcatttattcgctcacccacccatccatccatccatccatccatccattatccaacagactttccttgaggtaccaggattcatacactaccgtattataggctccataggactctttcttcactnttcaggttcagnacaggagggntattgttaaggggtatggggtttncctttncggggggaacggccggggcattttnaacagggggggtttnaccagggggg

SEQ ID NO: 1075 - DNA, 312 bp, Homo sapiens
tcactctttccttgtttattaaatatcaacttttcctgcctaatgggctgaggttcattttcccattcctcaaggtaagggtagactacctaggaacttattgcatctttaggccagctggcttagtgctacccatctgaacccccagattactacccaagtcttccttttgccccttcctgccctaacagcaagtaccaggccagtcccttccccagcaaatgccaggggcttcatgtgaagaggaactggccacaaggatgaggggaggaggagaaactgtttctgcaggaaggacagcagtgcctccag

SEQ ID NO: 1076 - DNA, 359 bp, Homo sapiens
  misc_feature (136)..(136): n is a, c, g or t.
  misc_feature (139)..(139): n is a, c, g or t.
  misc_feature (254)..(255): n is a, c, g or t.
  misc_feature (257)..(257): n is a, c, g or t.
ttttttttttactgaaatgacttttaatatctcatgtcgcagcaaaattaaaaatatacaaaaagtttgtggtgtacaaaagagtctcagtaaagaggccccagctcgggccacctccccctccccctcctggganagnctcggagggtgaatgggggtcagggggatgagggatggcacagatgtagtaaataccaggaggtgggaccagggaaaaggaaacagaagaggacaggggtgagggcccgttaganngnaagagacgacagggaggggaagaatcacttcggaattgtgctgacagagggagattagccccttcaggcatggcttagtgattcctaggagttccaggggca

SEQ ID NO: 1077 - DNA, 337 bp, Homo sapiens
  misc_feature (324)..(324): n is a, c, g or t.
ttttttaatttaaaggtttagtttatacaattgataattctgcaaaccacaattatgtcaataactacatactgtaataaaaataaacaaagtcatacttaattctataatgcattaagaataacctaaaaaaacaaattgtgaataaaggcatatttaataaattagggaacatcttaacttctaatagactgggggaaatttttaagttttctatgtacacaaaggcagtgggaacaaatgaaaaaaccaattactacattgttgcagcacattaaagactggatggtgtatattattcacaattacatcctctttcccatngcctggcagagga

SEQ ID NO: 1078 - DNA, 412 bp, Homo sapiens
ttttttttttaggaagtacctcatctctagaccttaaagaatgggcagttttttggtcagtcaaaacaagagaggcaatcctattcggggtgccagtaggtcaatgcaaggactgtagtggtggctaggtggtacactgaagctagatgatgaaggctctaaatgccacactaattttcactgaacatttctgaagagtagcatataatttataattcactaatctattcttcagcaatcacagaaaagcttaagatttaggaggccactatagtagttcatcaatgaggtgttcagagcttggattagagtaacactaagaacagaaaagaacgattggctaagtcctttcaaagagaatctgaaggactttgtaagttggatagatggaaaagaggagtcaaagctgact

SEQ ID NO: 1079 - DNA, 373 bp, Homo sapiens
ttttgctcatatttattttattttgattttttaatgctgcacaagacaatatctattttttcttgtatttatatgctgctatttactgaaagtcagagggaccttatgtggcctttttctttttctgtaggccaccttagagctttctaaatttggaatacttgatcaagctgaaagaaaaagggagtttcacaaaatcaatgggggtggggaggggaaggctgcttcattaattatgccctgtggtggttgattaactgcttgtacaattgtttcacttttaataaattacgcttacagtgctcctgctgatgaaggcacctgagctgaatacagttacatccggggtacaagtgaagggacagtggcatta

SEQ ID NO: 1080 - DNA, 457 bp, Homo sapiens
  misc_feature (283)..(283): n is a, c, g or t.
  misc_feature (423)..(423): n is a, c, g or t.
  misc_feature (432)..(432): n is a, c, g or t.
  misc_feature (446)..(446): n is a, c, g or t.
ttttttttattctaagaatataagtcatttaatactgttaattttatagcacaaaataaaacaagctatgatccccaaaaataattttaaaagcttacacagaaaatattattgcctgaagtttatgatctttaagttacaggtcaaaagagttttatgttgttgttgttgttgttgttgttgttgttttaaaacacacagtgaaggaccgtctaaggaaggcaaggccactgttcctcctgtaggggacaacgatcctgtctcagaggacctgtccttctgnctcctttagaaaacagaaccaggcacagcgttccacaccggacaggcagttactaggggggcatagtcctccggttcggcagaggggtgggagttgagggcagagcttcagtgggtgttccacaggaaaggcattagttnttagggtantgtgtttaaaacantcaaggatttc

SEQ ID NO: 1081 - DNA, 446 bp, Homo sapiens
aggataacagtgtttttaatatttaagtaacaaaacattcaggttaatactcaatgcatatacaataagatagagcaacaacaacaaaattacaaagcacaatctaactatatggaggctttcaaacaattaaatgttggatagagaatgcgctaattaaaaacccagctgagccacaccgcactacctgagacctgacccaggactttctggtggtagaagggagagctcattgtgccctgtggccttcaactcaaatggatgctcttcaactcaaatccagagagcacttaacaaactccatgctctagattgctcaaccctcctccttgcttttcttttttctttagttgacttgtctgctcatcctttacccaaactgaggcagtgagttccacaaatacttcctctggtttggtttaaatgttgctgtctcagtgagaagg

SEQ ID NO: 1082 - DNA, 402 bp, Homo sapiens
ttttttcagttgtcaaactactaacatctttattttgtcaagatatttaacaatattaaaaagttcagatttcttcatggtcatgtcttttaccagcttttcaaagattcattcagtagtagaaacagccaaatgctgctacaacgcagaataaactgtcattcatgaaaacatcatgagtatagttgtcagtgtcagcatcccagaaacagcgagaagccatgaatactccttcacctctttgttctccaatcactacttgcaccaccattttgtatcggtcaaatcccatttcttttaatttatctttaatgttttctgataaatgttttgtaagctgaggcatttcttctggagaatattcagcatttgccagttcctccttgagcacagcatggatac

SEQ ID NO: 1083 - DNA, 485 bp, Homo sapiens
agtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtcactgtgaatagcagtttctca

SEQ ID NO: 1084 - DNA, 466 bp, Homo sapiens
ttttttttttttttttttgaggctttttcatggttcttggaaatttcttttgaataagcctaaacagtagtgtgaaagatatactgacttcctgccgaatacccagatactccattaatgattgcattatcaaatgtttccccttcaatccagctcaaagtgtttgtgagaaatacatggggaaagaatgagcagggtggagtggaaattggaccttccggagaagccccaggaagacattaccactggaattcccgtcccaggggaaaggcccctcccaacagacttgattctggttttggtctaccagtttcaaccccagcacagcttccagaagtctttgcgggaattcagagctgatttaggacgagtcacctatcgagaggacgggaagctttgctggggacgcttgtctgtccaagtaagaggaggccatgtggctgtgtgacagatgtgttttgtttct

SEQ ID NO: 1085 - DNA, 1894 bp, Homo sapiens
tccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctc

SEQ ID NO: 1086 - DNA, 402 bp, Homo sapiens
tagtttatatgtataatttatttgttttcatataatttagagaaaacagtccttaaggataatgattactttaaaaagaaagcccttaaaatcatggaagatgtcacttgagaagaaatccatccctcaatgggtcgtcatcttctattataaagcttgctgtacccgtgtaatgggcttgtcctgatacttccactataacagctttaaaatcaccacatttcgcttccctcacagctttccctgtgaatactgagccagttgcactgcttttgaaggctctcatctggttcagttccagaagccctttgtgatactgtaaggcaattcgggctgtcactcctgagccagtgggacttctgtcaacctgttcatctgcaaaaacacaaatgttggtggttg

SEQ ID NO: 1087 - DNA, 318 bp, Homo sapiens
tttttttttaagagactgtacatttttatttaataaaccacatggcaaaacaatactttaataagtgtataggaaattacaatgtgaaagttgcaaatacagcacatatatatatatatatatatactttgatcttaattaacatggacaaaccccagcttcaaaatctttctaaaatcaatcatatgcaaaatacctggtttctgaaagggcatatgataaagtatatacaatttcttaaactgtgatatggcttatttaataacatgtatttattgagagaagcataaactttccaaatatacagtatcttccagg

SEQ ID NO: 1088 - DNA, 562 bp, Homo sapiens
tttacaagggtttaccacacttttattgctttaagaattgaggtttggcctccacttccacccttgttgctactatctcaagtgaaataactcaaaaacaggaggtcaaatacttcacattctcacttataagtgggagctaaataatttgtacacatggacatagagagtgggataacagatactggagactcaaaagggtgggagggtgacagggcaagagggatgggaaatcacttaatgggtacaatgtactctaattgggtgatggctacactcaaagcccagacttcaccactgtgcaatgtagccatgtaacaaaaccatacttgtaccccctaaatctatataaagtaaaaaagaaaaaaaccccaaacacattggcttttattttatttttccatcaaagacaccacactggaaagaactgagtttatctaggattctgttttgctcacctgtcttatagtaatcataggctttcacaaaagcaggtttcagctttcttatggggttgtcttgcagaagagtgaaagaaaaggtcagtgttcaatccgtaacc

SEQ ID NO: 1089 - DNA, 405 bp, Homo sapiens
aagtggcaatgtgacttgtcgtttatttcaatgaaaatttaaatgattcttacaaatcctctgaaaagtaaaactgatacttttataaacagaagtatatgcaaacagtcacaatacgcattaggacgactgacgatatttcttacatgccaggtagttcttccatcccagcaaacacctcttatctgaaagtgttttttctcctataaatttgcatctaaggtatttttaaaaagtcaaaaacagtgcagagtaactttgaattgatcaacaagaatattatacaattgtattatagttccactccgaatacgatagctaaaaaccaaatcaaccttctctttacagaacacaggctccaaacataatttcttaaatcatggtctgccactgaatctggctata

SEQ ID NO: 1090 - DNA, 402 bp, Homo sapiens
tttctatgacatggctgccttggggtttataactcaagcagatgctaggcatgaaaaggattttcaacttcagaactgtagagcaagcgcaggagacaggttcagggtttgccagcagatccacttggccttctggtttcctcaactctctttcaacctagtatgtgtgcgcagtgccaagttctcagctacctccccagctggagccacagcataatgacagtgaacacatgtccacacataccagcccgcccatcagtctggcagccagtagggttcctggaaagctggggagggtaggtgtgtgtctcatgcactggtagggggcctcggtccacaggcagttcttgaggtccttgttgaccaggaagccaactggggctgacagcaacccagacaaac

SEQ ID NO: 1091 - DNA, 2664 bp, Homo sapiens
agagccagcccggaggagctagaaccttccccgcatttctttcagcagcctgagtcagaggcgggctggcctggcgtagccgcccagcctcgcggctcatgccccgatctgcccgaaccttctcccggggtcagcgccgcgccgcgccacccggctgagtcagcccgggcgggcgagaggctctcaactgggcgggaaggtgcgggaaggtgcggaaaggttcgcgaaagttcgcggcggcgggggtcgggtgaggcgcaaaaggataaaaagcccgtggaagcggagctgagcagatccgagccgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttggggggagggcggttcatcctcttctgcttcaaataaaaagtcattaatttattaaaacttgtgtggcactttaacattgctttcacctatattttgtgtactttgttacttgcatgtatgaattttgttatgtaaaatatagttatagacctaaataaaaaaaaaaaaaa

SEQ ID NO: 1092 - DNA, 432 bp, Homo sapiens
tttttcacccttgattctcaaatgtttatttttaacacggcagatacttagcaattatatcagaggctgaggcatctggagtaagcaagaaaggtgatttgggttaataatctttgaaaggctaaaggattttcaatgtatgtataagactgagccctgtgcatgctccccattctctccctgacatcagccacatccaccccacctctgccgctacacgttggtgctacccaaggtctccattcacgcactgtccctctgcatctcatgcttcatccgggccctcctctgacctgaccttacctggctgacttagtgccccaattctctaaaacatggagagatggaactggtagcttgaaccctcccagttccatctcttccctttgtaagttttcccggtgcccttgggcccatgtttctagactatgc

SEQ ID NO: 1093 - DNA, 3468 bp, Homo sapiens
ctcctgcatagagggtaccattctgcgctgctgcaagttacggaatgaaaaattagaacaacagaaacatggttctcttgacacttcagtgttagggaacatcagcaagacccatcccaggagaccttgaaggaagcctttgaaagggagaatgaaggagtcatctttgcaaaatagctcctgcagcctgggaaaggagactaaaaaggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggatccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttt

SEQ ID NO: 1094 - DNA, 482 bp, Homo sapiens
  misc_feature (419)..(419): n is a, c, g or t.
  misc_feature (477)..(477): n is a, c, g or t.
ttgaggccacagcgattttatttggagaatgaagggcagaaccacagagatctcaggagggagggcaaaggtaactcatcgtcatccacagagaggggactcaggattacgctgtgcgtccaggccatcttccctcccagcccagccttggcacaagtcggccccaggatcatcatgtgatagagcctgaagcctgtctccccaagtccctggaaagtagacatctgtgacaatcctcccgaatcccagggcacagggagcatggctgagcacgccagactgcctgggctcaaattctgtcctgccatgaactgcctgggtgtctttggacaagtcatttgacagctctgagcctccgccttctcatctgaggacaacaggaataatgagggtacccacctcatggggatgtgatgagngctaaagaagaaaatgcatgcaaagttttagcacagtacctggcagtgagtatatgtngcata

SEQ ID NO: 1095 - DNA, 380 bp, Homo sapiens
  misc_feature (152)..(152): n is a, c, g or t.
  misc_feature (282)..(282): n is a, c, g or t.
  misc_feature (304)..(304): n is a, c, g or t.
  misc_feature (332)..(332): n is a, c, g or t.
  misc_feature (343)..(343): n is a, c, g or t.
  misc_feature (348)..(348): n is a, c, g or t.
tttttttttttttttttttttttgtttgaaaattaaagtttattaggatatattaatgtatgatattatagtattactcatcacatgtaagctttacatctgaagcaattcatgcttactgggagggaagtttgagtacttacttagctttncctgctattcctaggtaaaggccctcctgtggtcattctgaacagaaggagtgagcttactgcaaaccacagggctgggacagtaggaggggtgccatatcctcactgagtgggagctcaggaaaagganttagggattctgcacacatttnttccagactcagttccccactgttgggnttttatattgnggttnttttaaaatcttttcggaaatataatttattt

SEQ ID NO: 1096 - DNA, 1275 bp, Homo sapiens
ctgtattgtggttcctggaacacttcagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaa

SEQ ID NO: 1097 - DNA, 419 bp, Homo sapiens
tttttttttttttttaacagttcctagagatttattataatctgtttcttctttggctttttgctttgccccatatgcacacatagtagagatttctataatctgcattcttctttggcttttgttttgccacatacacacacatactcaaataatcaagtggcctaaacacagagattagaaaccaatcagtaagaaatcagaagccctaccagtctacccctccccgaccctgcatctgatgtggagccatagtcaagtgcctaggaggaagacaagcttgaaggacgacccttaataaagagcttctaggaaagttcagagatctcagaagaacttggtgcacagccaaagcgctgacaaaggcctaggcgctagctttctagaacaactggaaaatagccacagctgccttccca

SEQ ID NO: 1098 - DNA, 329 bp, Homo sapiens
gagaagacgacagaaggggatgcccaagaggagtatcaatgcccagaaaaatgcttggcttagagggttttgagctttaagtttctacttcaatttgctgtaaattgaaatttgtcagtttgaactcatgctgtgaagagtttcagttacttagcaaagaaaaaataagctggatcagggcttatctacatatcaaaacaaagttaggaattctgttgtataactccaaatctaaaaaataacttcatacctactagctgatagacaaaatttcactgttgaatgagaagtaaaaaaaaaaaaaaaagaaaagaaagaggtcgtatcga

SEQ ID NO: 1099 - DNA, 525 bp, Homo sapiens
  misc_feature (58)..(58): n is a, c, g or t.
  misc_feature (375)..(375): n is a, c, g or t.
  misc_feature (428)..(428): n is a, c, g or t.
  misc_feature (448)..(448): n is a, c, g or t.
tttttttttttctcaacatggaaaaactgttcaggcacaaagattaaacaagcccgcnttgcataccttggattgtactgaatcactgggtcccccagcctccctacctacccctgcaccccagatctgccttccccatattcatggcctcctcctccaaagcagcccaaagcagcaatgatatttactattttatatcaatctcttggctatatatatatatatctatatatctatatatttgtctatcctatatatacatagggttttaatgctttggaatgaggtgaaggggtgaataggggaaaggaggcacatgaggtgagggtgtaaatgttcaccaaatggcattaaggggacatatttgtagggagnctgggacatgggggaaaggggactatttaaccaacgtgggccttgccgggggntgggaggaagtttttttcantgtggtcggggttagggccgttaggcaaggcggggtttgttcaggcagtacccccagtttaagggcggccggggggg

SEQ ID NO: 1100 - DNA, 368 bp, Homo sapiens
  misc_feature (256)..(256): n is a, c, g or t.
catttctttataaaacagtcatctcactagcagctctctcccctagagtaggggaagggggtggaggaggttgggcacctccaaaggagaaaaaggatagcagggaagggcccaaggttacctcctgaggttcttctgggcctgtttcaacaatgtgtcaaagtcaagagaatcaaatttgctctttacaggtgctggggtcaaagtcttccccggttgggagtcaagatccaggaatagctccctcttgcagganctgcccttcgggcccccaaagcagaggatccaaaggggctgctcatctgccctgcccgcagcttgtggggccactctcaatgggccttgcaaatgcctccctcaggcatagg

SEQ ID NO: 1101 - DNA, 859 bp, Homo sapiens
cctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacgcagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagacggtttctgcaggtaatggtggcagcagcctctcttacacaaacccagcagtggcagccacttctgccaacttgtaggggcacgtcgcc

SEQ ID NO: 1102 - DNA, 384 bp, Homo sapiens
  misc_feature (370)..(370): n is a, c, g or t.
tttaacattgtaagtttgtgaagcaggatgaagggagtccaggtttctatttctgtacttgtgctccctagaaggaacagagtttggaggactgtaaaagaaaagtggaggtaaaagtgtttcctccagattggaaggagatgcctgaggtgcaagggaggagcagcaggagtggtcagttggatcagatcgcagcaggtgcatttcactttcctgtagcctcatcgtcctagcaatggctcagcattccaaccatggaagctgcagaggagagtagagggacgctggatgggattccctgcatgcctttgactgatgtttctctccagggctctcacatcagcttcattatccgtgaacaccaacaaangcgcggtttcctcc

SEQ ID NO: 1103 - DNA, 286 bp, Homo sapiens
tttggttagaaactatatttagaatttcaatagaagaggccagaaacacagctgcccacatctgaaagaacctcagcagtaacagtgggggattaccaagcaaccaaggaaaatagaaactctccccactctgagctgctgatggtgactcctgtgactgagggcaaaatgacggctgaaagtgagggctaggaaatttaaggaaaagaaaggtgtggcaaagatgtgacagaagggttttctagttaggtgaggtggaaccaagttgagtggaatgagcacatgc

SEQ ID NO: 1104 - DNA, 510 bp, Homo sapiens
acaatgaacatgtattgttttattgcctttaataataaacattttttaaaaaacaagttcttaaaataaataaataaataaataaattctaatgagaaaaaaagagggacctccatttccatgatcctcctccacccaacatcccaccatctccaccgtctccaccctatccccactcccgggggtcttacatttcagcaatagcgatcgctctggtgaggggctggttttcaacaaggtacctggcttggtgctggaagggtctgagagctggcagtttatgcctgtaaggaattgttgagaaatgagcgcccggagcttatgcaagcagacaaataagacgtgctaaaaataccacacaactggagattcgcataatctcgcccaagagctcatttaatcctcacagcagcccaggagaggcgactgcattatggtctccactttacagatgcagaaacagaggcatggaaaagggaggagccgtgtctaagatggcagggttcagca

SEQ ID NO: 1105 - DNA, 615 bp, Homo sapiens
  misc_feature (291)..(291): n is a, c, g or t.
taattgactgggtttgtttattttaacactttttacaagatattttagacataccaaaagtgattttttttcagtgcctcttgtaactataaatctctctaatttatagtctcatagcatcaagtgtcattacaatgatgagagtaagtgcacacacctgcatagtcttcaatggatgcctggcctgctccatgtgctttacatacagacttctctagtttccccacaagcacacaaggcagatactttccccatggcaagcaatcaaaaaaagccagacacagaggggcngaacagctgctgaggactgtactgatgcacaccccggtaggcagattcccaagcccttgttctggagtttgtgtgctggacggcctgtaactagtacaaactgacctttggtgtctcttctctgtcctccctgcatccatattgtaggacaggagaaaagaaagggagaagctgttgcattattaaatcttccacagcagatagttatggagaatcacagttttgggttacacattggaggtcacccagctgttggttttcaagcatgtctgtgtgctcctgctcaagggaaggctttattccttaccccttcaaccggggatg

SEQ ID NO: 1106 - DNA, 2474 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtggacacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcaggctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcatttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctgga

SEQ ID NO: 1107 - DNA, 271 bp, Homo sapiens
gctcgacggaagaaatccaaaacctgaacagaccagtaaccagtaatgagattgaagccataataaagtctcctagtaaagaaaagcctgggacctgatggcttcactgctgaattgtaccaaacatttaaagaagaactaataccaatcctacttacagtattctggaaaatagactaggaagaaatacttctaaactcattctacaaggcctgtattaccctgataccaaaaccagataaagacccattaaaaaaaaaaaaagtcgacg

SEQ ID NO: 1108 - DNA, 472 bp, Homo sapiens
  misc_feature (433)..(433): n is a, c, g or t.
  misc_feature (437)..(437): n is a, c, g or t.
atctgcttgtattgattcaaaagaatggtctttgagttctgagattctttccttagcttggtctattctgatattaatgcttccaattacattatgaagttcctgtgctaatttttcatttcagaagttcagtttggttctctcttaaaatgaatatgtcctctctcaactcttgaaccattttactgttttctgtggattgagtttcaaccttctgtatctcaatgagcttccttgacattgagattctgaattctatgttatttcagtcatttcagtctggttgagaaccatggctggggagctagtgtgatcatttggaggtatgaagacactcttgctttcagagtggctggagttattgcactcgcactttctcacctgtgtaggctgatgttcctttaatctttaaagttattgtcttttgaatggngctntttgcctttatattcttcaccatcatgcccagact

SEQ ID NO: 1109 - DNA, 401 bp, Homo sapiens
ttttaaaagaatagccatttactcccaagttcccaggctgtgggtcacactgggtttgtcttctttctttgagatgtgagtctagggtccgcagagaaagctttgctttaggctgtgggtcttcaaggcagcaggtggagctctgcttaggtgtctcacttggggacccagctgaaagacagggctaccagaaatgaaactgcctttgcaaagatgatgacagtgagaaaagtctagcatggctgactccatcttgcttccagcctcacaggttggctgtctttgctcattcctgcagaggccaagcaataacaagaaatgaattattgacaaatgcagtaacttggatgaatctccaggtaattctgcttccctataggcacactttctcagtggaacca

SEQ ID NO: 1110 - DNA, 508 bp, Homo sapiens
ttcagttctgtaccatttaatgcgtgcaaaggacattccatggtgtctgctgggttcagggcaactggctttcccaaggcatacaagaaaagttggcagaaagtcctcccctttaaaattcaagcctgaaggttttgtgtgggggcctactgccccctaatgtcttctggtgatactgcagcacagtccatcaaaatagtttgtggttttgccatctgttactccttatgcccacctggagaggggctagcatctttaggtgggaccacccctggcacaacatggtctctgaggtccagatactctgagggtaggggctggctctctctgcctccctatcccctacaagagggacagggagaggtagaacattgggatctttactcagaggctcagatggacccttgattctcccaggagtcatacattgaaggtaccagagcttccattttataaaagaaagcaagcctgccgtggacctgtcagccccacgatatctgtcggcatg

SEQ ID NO: 1111 - DNA, 384 bp, Homo sapiens
gcagcagaacagtctttatttatcacaaagaaaatagcatgaactttaatatgtagaacagatcagaccagttatactgtaattgaagtttcccttctgctaccctccacaggaacctgagctccacaggactcaatgaaaaagcaactgctcaaggttggatccaacttttgtggggcctgaggttacataccttcagggtcaggttggtttcctgaggcagtgagcagggaaggaggactgatggtgatgttgcctcatttggatactccatgagcctacgcaagtttcacaaaagctccgtagatgtggccaacaaaattgctccataaattggacactgcacaaagaagtctttaacgccattcctgggttctttgtcaa

SEQ ID NO: 1112 - DNA, 435 bp, Homo sapiens
  misc_feature (10)..(11): n is a, c, g or t.
  misc_feature (25)..(25): n is a, c, g or t.
  misc_feature (188)..(188): n is a, c, g or t.
  misc_feature (285)..(285): n is a, c, g or t.
  misc_feature (288)..(288): n is a, c, g or t.
  misc_feature (329)..(329): n is a, c, g or t.
  misc_feature (340)..(340): n is a, c, g or t.
  misc_feature (433)..(433): n is a, c, g or t.
tttttttttnntttttttttttttnatttacaaaagaaaggtttaattggacttacagttccacatggctggagagggttcacaatcatggtggaaggcaggaggagcaagtcacatcttacgtgaatggtggcaggcaaaacaaaagagcttttacagagaaactcccgttttttaaaatcatcagntctcatgagacccattcactatcatgagaacagcataggaaagacccatccccatgattcagtcatttcctaccagggtccctcccacatgtgaganttntggggagctacaaggatgagttttggggtaggggacacagngccaaaccatnttcattccacccctggggcccctcccagttttcatatctttcacattttcaaaaccagttcatggcctttccccaacagttcccccaaagttntc

SEQ ID NO: 1113 - DNA, 1953 bp, Homo sapiens
gcagaccttgcttcatgagcaagctcatctctggaacaaactggcaaagcatctctgctggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactgttaaagtctccaaact

SEQ ID NO: 1114 - DNA, 257 bp, Homo sapiens
ttgacggactctttttaatctatacagtgatccttaatctttggggaaggggacaggtcacacacagactactttggagaatacatgaaagctataggtgacttcatcccacctccaaaatacatgcacatatgtctcaactttcacatacagtttcggggggttcacaggtttttaaaaaatccagtaaagaactcatgcacttgtgcttttccttgccactgtcttttcagtaaagagaacatccagccagcccc

SEQ ID NO: 1115 - DNA, 439 bp, Homo sapiens
tttaatatttcattttaattcaagtattatcatctcaacatgtaatcagtatgaaaatcattagtaagatatgcaatattattttcacacttacagcacatatcaaacagactagccatattacaagtgctcagcagccacaacgttactagtgactaaggtagtagacagtacagctctaaagacttgagccccatctctctctttgcaaaaatggttttaaacttgacattttaattgacttttggctgcagtaaaagaatttaaaacagtcttactaaatggtggaaagtaatacctttcaatgaaggtatggtgggccaaaacaaagaggtaaaagagagatttgagtcagaattatttattgaaaaatctccccatgtttcaatttattcatttaaaacaaacttttatttctaacttgaacaaacactgtcaa

SEQ ID NO: 1116 - DNA, 611 bp, Homo sapiens
ttagtgttggttaagcatttatttttgcatcctaatcctaatatccactctatgaatttaggacctactattactcccattttaaagataagtacaccgaggtttaccaagattaactgacttgccaagggtcacacactggagtaagggcagaaccttagactcatgtctgacccctcgccccatgctcttaaccacataatgccatcttttatttcagtgacaagacaaaagcatttaggtcacactcttgttgttaaacaggaaaattatataaatgcaaattgtttagaataggttttggatttccttttgagcaaacccccagtcctttaaaggatatacttaaaattttttttaagcagaggaaaatagactactatttaccaatgacaagtttatagagttttaaaacgagaggttttttaaaaatctgcatccaaggtgaagacgttatctgtggtttctgccataactgcaaaacgctgatactctgaaactcgtttctcaaagaaatttgtttttccttctaaagaaatgttttcccataaatcaaaaggattttctgcctgaaaaacctttgagaatccaagttccacaagtaatctgtc

SEQ ID NO: 1117 - DNA, 495 bp, Homo sapiens
aattggtaatgtatttattttcagatctacacagaagttgctaaatacaatgctgtacatcaacagaagttctgcagaaatagtaaaattttcctttatctccacctgggaagtctgaaaacatcatagggcttgtgactggggcctaataaccccgaggacaacgtggtgggctgagcgaatacctcaatgtgcgagagaacgaaaagctcgaaccacgaccgtgcctagggaccaggcttttcctgtggccgatgcggggcagatgcagacccagaggccacccttgcgcgcgatctccaacccgacggtgcggctcctctcggacctggagctgtggggagaaggcagccttttagtgaggagccgccgcgtggcgggacgcaaggaaaaccacccgagccgctgaacagtattccgcgactgcactccagggcaccgggaccgccagggtgaggagggactctgcgttctgcaaagctagcggttcccact

SEQ ID NO: 1118 - DNA, 467 bp, Homo sapiens
  misc_feature (398)..(398): n is a, c, g or t.
  misc_feature (456)..(456): n is a, c, g or t.
  misc_feature (463)..(463): n is a, c, g or t.
attgacataaacatgattagcgatttctggaagcatgtgggatgctgcattgataaggatatgaacctccttgagtaataatgtatatttttactccgaatactgtttcacattttgggtgttacatccttacttcagacttctgccttatcagtggccatcccaccctatgttcttatctcctcagtctaaaaagaaaaatggggacccatcagaatttggatagaagaccctccagggaatttctgccactgcttattcatggggttgggcacagacactgattcagtggggcacacaggagttcaggaatgattcaggaggcccaggatatgtggccctaaggtcacatctccaggcgtccgggggagggacttgttaaggtgcttcgtttatcnggggaaaaatggaaaccaggggctcaggctactcctggaggtcatttaaaactccttncccttgntttt

SEQ ID NO: 1119 - DNA, 2329 bp, Homo sapiens
gttttctacccaagaatgctacttcaggagatcagtcaaaaggttagggtgatggtgacggtggaaatatagaaaaaggaatttattcaagaggtattcaaaaagaagtgaaatagagatgagttggagatagattggataaaaagagtgagggagagggaggtgtcaggctgcagcccaggttctgagttgccaaagaggagtcttttcctccaggaaattgagacacgccggttgtgaaacctactgaagtgagcggcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggtgggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcataaaaaaaaaaaaaaaaaaaaaaaaaaaaaaaaaaaaaaaaaaaaaaaaaaaaaaaaaaaaaaaaaaaaaaaaaaaaa

SEQ ID NO: 1120 - DNA, 386 bp, Homo sapiens
ttttttttttttttttttttttttttttttttttttttttttttttttttttttttttttttttttttttttttttttttttttttttttttttggggggggggcccggggttaaaaggcccccccccccccccgaaaaggggaaaaaaaaaaaaaccccccccccccccaaaaaaaaattgggaaaaaaaaaagggtttcccaaacccttttcccgggggggggaaaaaaaaggggcccccccgcccccaaaagggggaaaaaaaaaggggacccccccccccccccccgggggaaaaaaaaaaaggggggggggggaaaccccgggcccgggggaaccgggggcccaaaggaccccagggggggggggtccccccccccccccc

SEQ ID NO: 1121 - DNA, 317 bp, Homo sapiens
tttttttttttttttttttttaggattcttgggctatttattggtacatacattggctaatagaaacacagaggaaatacaaaaattgtaggaagacatatagtatgtatgcacaaattcagtaaacatttatcaaaccaccaccatattttaggcataaatccagtaatattttgaaattttaaaagatcatttattaaaggggccttgcatgaaagtacagcattgacagaccaccctggtaaatgccaacccaaatatttaaccagagatataaagactaagtttgaaacagagctgaaagcataatacttaaa

SEQ ID NO: 1122 - DNA, 267 bp, Homo sapiens
  misc_feature (133)..(133): n is a, c, g or t.
gaatttttaggccatctattcaggttgaaaagaacccatatttttatgtatatattttttttaactcaacatcatctctgcttcaagtatctattcaagttgtggcagaaaacaacattgctaggttccaggnaaacaaggacagcatgtcttgttaaatacaatcatttcaggatcctccccaagtctcaccctgcagggctgctaagtgcagggagacaatgcagtgttggggacattgggagggcagggactatgggaggctgt

SEQ ID NO: 1123 - DNA, 450 bp, Homo sapiens
  misc_feature (394)..(394): n is a, c, g or t.
  misc_feature (427)..(427): n is a, c, g or t.
  misc_feature (450)..(450): n is a, c, g or t.
taagtcaaaggtttaatcatgatccaagagcccagagagactttaggacaataataggaataaagcaaggcccacaggctccagctcctgatgcccagatgttcggcaggatccggggacagggcagtgcaggcagttgttttccatcctccactcagaggaggagacgagggggcaggagcttcttcacaaaggagaatgactttctaggctgcctcagaacacccagtcctccctaccctaaccctaatctggaatgcaatagagaaaggctaacttattagattctggtgatcctggtagtcaagaggaagggctcagaaaggggcttggtggagctggtcaccaccagatggacatggctaaattgtggccaccaaggaggggcagcatnaatcagaagtggagatggggtggagggaatgangactggaccagtaaggatctggn

SEQ ID NO: 1124 - DNA, 437 bp, Homo sapiens
  misc_feature (414)..(414): n is a, c, g or t.
aagcagttggaaaaacgggatcagcaataaatactataaaacaaacaatattaaatatggaaaatcaggagataataacctgatgacccagaggagaatatataactctggaaattttctcctacagaaaccattggaaaacagtttaacatttttaagtagaaaacagaatggtatgggttggtgaaatggtgtgtgtgttttacatggcttgagtccttctcctgtttctggtaaaagaattccactttctctcgtgagaattgtccctttcctacacggtggtagtctttaatctaaagtgccttcccctcagtccaactggagtatagcagtcaaccctcttctgtgggttttggctttcttcagtttcagttaccaatgggtacaatacaataagatattgacagagancagagagaaaccacatttgcata

SEQ ID NO: 1125 - DNA, 338 bp, Homo sapiens
  misc_feature (284)..(284): n is a, c, g or t.
ctgagagctgccacaccggttttccagccaacagagcaaagatgcgcagtctctcatcctggatgaaggagtctgctggagctgatgccagtccaccaactgcatggtgagcagctcccggactgactggctacccacaaactgagataaaagaagagcaagacgatgatcccctgactgctgggccagagagcaggcctcactgatccttttgcctgtgaggtagctgaatacagcctccacagggctgtttttttgggttaaggagacttcctcttcatctngaggtgtgggcagtacaggatagccagcgggagaaagctcttcttcgctccaga

SEQ ID NO: 1126 - DNA, 363 bp, Homo sapiens
tttatattttggagtactttattatgcagtggtagataatgcaaagtctaaggcggagggcatctcactgcaaaaataacttgaagattttgacgttcttcaatcataaatggacagatccagcagacagaacatcagtaaggacatagtcaaactcaacagcataatcaatcaccaaaatttgtggggtacagtgaaagcagcgcttacagcgaaatttatggctttgggtgagagtgatgtgtccatgtaggctcattgattgtaacataacgaccactcttgtgctggattttgatagtcaggcaggctatgcatccctgagggcagggtttccataggaaatctccgtagcttctgctc

SEQ ID NO: 1127 - DNA, 227 bp, Homo sapiens
tctctctcactgcagaccatgtttctccatgtggcagaaaacagccactcactgcacccacatttaaatatagcttgtgatgcaaaaattacacagacaaaaaagatagtcctagctttctagaagctttctagtgggaaagataaaacatgcaatgattatattatcacagtgagaaacacacgtacaggttcatatagattcaataggcattaacaaggaacaag

SEQ ID NO: 1128 - DNA, 357 bp, Homo sapiens
tttttttttttttttttttttctggggtggggctgacgtggtgaccgtgggcctgatcagataaaacctttacaaagaaacagtagctctcagactcacctcctgagacagagttgttctgaggggaaaatgggtaagtttccacagtaacatacagtacttaaacatacagtaagatacagtacttaaagccctgacctgtccagttcccaacacatctttcttgatgggcacctaaatgtcaccttttggttttatttttgtgtttttctcatctaagctcagagagcaaagcctgacagggtgagcccccaaagtgtgttcatgtcttaagagtgtccagaagccacctaggga

SEQ ID NO: 1129 - DNA, 392 bp, Homo sapiens
tttttttaacatttattttaagttcagggttctttttcaaatcaaggtgtcaccacttccatgaaaatgaaaggagaatcaaatccagttgctacctgacaaagcattaagaataattttgattatggattattttgttgttttatgcatacaacctagaagaatgggtgctactgctaatataaagcactttttaatgaccatctactaaattcgtaagtgaggtttctcaacacttttcaatattaaagtaaaaaaggaacagaatcaagcagaaccccatcttttctaatatttagaaatggataaaataattgaaataaatcagccccatctatcccactgaaaacgcatttctgacaaaattttactttaatacttattaaaatttg

SEQ ID NO: 1130 - DNA, 2602 bp, Homo sapiens
gcctcggcggcccccctcaccgcgctcccggcgcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcag

SEQ ID NO: 1131 - DNA, 455 bp, Homo sapiens
gcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccgcgccccagacccctgccttgctcctgcgaaagtgccttctaggtgcttggtggtcagagacgggtcatctgtcgctaaggcgcaacctccagggaactcgaggcctgccagggtctgtccagatcacaaggggcaagagagtctgtgagagagtgacactggag

SEQ ID NO: 1132 - DNA, 416 bp, Homo sapiens
ttttcactttgcagttagctctccttcccttgtaaacagttttattcatttttaagaatcatgcagcaatccataaatattgcattcttgatgtccccactgtagtgtgaccacaagtgtactccagggagaggggtacacagatggcacaagcagtatacacatgcacacaccaggtgtgcagaccaaagcaaagtgagcgaccagcgtgctaaactccaggtgggcaggaccccaactcccaggtgaggtgggcaggaccctaactcccaggccagccggcttagagtgtggtggtctgtgcccaggagatgcctcagcgggggtagaaactctggtgggatggagctgggcagaaggaaaaaagggctctgtgaggaagccgggatcacaccacctgaaggcaatagggagag

SEQ ID NO: 1133 - DNA, 529 bp, Homo sapiens
ttttaacaataaccattaattttttattaaatttgtagtcaaatatgacaatattttttctttcataaaaacaagcaacataaatatttataacattatcagtttgggaaaagacaaagaaaggaaaaatgaataaaagcgatcaaaagacaaattcgaacatagaataaatataccctgttaacatgcatgcttagccctgtggctgctgctagagtaccaggccctgagcctcacaatcacagttcaaaatctcctccagcttcaacatatccaaggcagggattttggcgacttcaaagaagaccgggtgagaatacttgtaatacacagccttgagactatcgtaagaactgaaagtcagcagtttgttcagctgtctgaccaaggggtgaagctcagagatactgtagccactgtaatgctccaggaagggaacccagtatccgagcttcttcatgtagagggcccagagtaaggaggcagcagctagctttggagccctctcctggacatagtgtattccctg

SEQ ID NO: 1134 - DNA, 609 bp, Homo sapiens
  misc_feature (352)..(352): n is a, c, g or t.
  misc_feature (433)..(433): n is a, c, g or t.
  misc_feature (479)..(479): n is a, c, g or t.
  misc_feature (567)..(567): n is a, c, g or t.
  misc_feature (581)..(581): n is a, c, g or t.
  misc_feature (591)..(591): n is a, c, g or t.
  misc_feature (602)..(602): n is a, c, g or t.
cctttggtctcttctaaaattaaatttcctaattctctctatattcttgtaccacttctcacttaggaactcacttataaaaaccagccatgacctgccattccttccccaggaaaccccgtctgctgctcctcttcctttgctttcttgagtcaccccataattaaacaaacagagatagtgacattgcctgagagaaagaaagagaaccagatgattcaaattaaaatctaagctacacaggataggtcaataggcaccaacccacccaaaatgtaatcctttttcaatccccagactaaacagagtaggaaataaagcagttggaataccctttagtacaaactctggnttcaaactggatgcaaccagttcaaaacaaaatcattacttcttcttaagacccccaaccatccacaggaatggattatgnagaagtctcacaactggtcacagggtcactgggctcccaaatactnccctgaatggagatctatcattcacaggggcagaagtcatccacctctacttttccatctaggtttttttctggcaatagcttccagngggaactaaagttngggaccttanccctaatggtnaataaat

SEQ ID NO: 1135 - DNA, 396 bp, Homo sapiens
gcatagagacagggttttgctatgttggccagactgtcctcaaactcctgggctcaagcgatcttcccaaatcgctgagatgatatgcatgagccactgcacctggccaagatccaggtttgcaaggtggcaggtgtggctatgatacagagacttgatataccagggtcccaggagtcagtgatatctcctgatgacaggaaaaaataaagaagtggggtttttggaatcaagacactagggctgaaccattgtcagccttattattagattattgtttccaggttagggctacaaaatgatgtgaagtcagtaacacatgtatcacagagccggaatgggagagaggaggggcagggatgtgctgggcagtactcaccgtcactgctgcaccca

SEQ ID NO: 1136 - DNA, 460 bp, Homo sapiens
ttaccatgtagtgctaccatttatttgaaagtcattttgacaacactgtgcatacttagagttttgggttaaagataattgtgtatagaaaactatagaaaacattgctttgaaagtgaagccagtatcaatgttatcctaatctctttgccaaaaaaaaagaaaactatctcttaattacactacaatcaaatcgagtcttcaactcttatatgctcattcagaattttaaaatctctctcacgggaggaaatgtaaaaggaaagttttcaagacctttttgtaccttaatatccttttcaacttctaatgtaaaacgtatttgtcctgatacaatgctgtgaaataaagaccacatcaggaatgtaatgaagtttaaaagtagctccttttttgcactgagaacaattttattgattcaaattagaaacttctaactgggggcaggagaaaaaggagg

SEQ ID NO: 1137 - DNA, 328 bp, Homo sapiens
ttttttttttttttttctacaaagatggtactgtaattttctccattttgtaaatgaggaaacaggttaaggtcacagagtaggggggagaactgagattcaaatccctccaatttatgaagcctaaattggcttgttccagctctgttgtactgatttctgtggaggtgattaccgtaaaccccacctgcctggtcctcttctccagccaaatttgaagcatttgatgtccctgtgttagtctgctagggctggcgttacaaaataacacaggctgggtagcattaatgatagaagtttattttcttggctgggcgcggtggctcat

SEQ ID NO: 1138 - DNA, 331 bp, Homo sapiens
ttttttttggtccgggcttttattttactaaaaatctaatggcaaaggtaaaaaaaactaaataaaatacaaaaaaaaaacaaacaaactaaaaaaaaaaaaaaacaaatacaaccaaaaaaaaaacctacaacctaccaccaccacaaaaaacaaaaaaaacaaaaaaaaagacaatcgaaaagaaaaaaccaacaaaacaaaaaaggcccaatggccaaaaaaccactggaaaaaaaaccgacccatcaattaaagcaaaaaactgacaaaaaccccaaaagaataccccgggagaaaacaaaataaaataaaataataaaaaaaaaca

SEQ ID NO: 1139 - DNA, 1995 bp, Homo sapiens
ctgtggcatctcctgtcacattgggaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcacgccagctcagccctacaccagtttccacctggagttcatgcaagggcaaaaggcagtgccatgcaagctgtttaaaataaagatgttaccttgtaaaatgcaagttgatttaaataaatactgagttaaaggctt

SEQ ID NO: 1140 - DNA, 2046 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattg

SEQ ID NO: 1141 - DNA, 469 bp, Homo sapiens
  misc_feature (199)..(199): n is a, c, g or t.
  misc_feature (296)..(296): n is a, c, g or t.
  misc_feature (367)..(367): n is a, c, g or t.
  misc_feature (417)..(417): n is a, c, g or t.
  misc_feature (428)..(428): n is a, c, g or t.
  misc_feature (437)..(437): n is a, c, g or t.
  misc_feature (446)..(446): n is a, c, g or t.
  misc_feature (465)..(465): n is a, c, g or t.
ttttttttattttcataagttgatatttgtattctcttaataccttacttattttatatatctttacatataaagcatattaatagaatttgtggccaatattactagttattacatcctttttatacactaatcattgctgaaacagtcttttatgcactgtatcattaatcgtcagagccatgttaagtatgtaggntagcagttatgttctatttactttcttattttggggggtttatttatataggatgtataatttatttatttatataggcaaggatggggggtcttgnctctgtctcccagtctaggaggtataggtgggccgcgatctcaggctcaccgcagccctcaaccctcccangggcccaaggcgggatccctccctctcttcaggcctctcaagtagggctnggggtctaacntaggggccnggtacccanccaacccccgggttaactnttaa

SEQ ID NO: 1142 - DNA, 427 bp, Homo sapiens
tttggaatatttgcatgatacttagtgttgagcatccctaacctgaaaatccaaagaaatgttccaaggaacctttcctttgagtatcatgttggcactcaaaaagtttcaaattttggagtattttggattttggatttttggattagcaatactcagccaatataatcttatgggaccaccattgtatatgcggtctgttattgaccaaaactttgtcatgtagtgcatgactatatgtcatttaggagttttgtgcatatctctgagctaaactctcaattatcacttatctttaaatgtctctatttcactcttcttaaaaggtagtctgggcaagtacataattctagttgaccattatcttttggcacttgaaaggtattattccattaacttctggtttccattgatgctgataataaat

SEQ ID NO: 1143 - DNA, 423 bp, Homo sapiens
  misc_feature (279)..(279): n is a, c, g or t.
  misc_feature (372)..(372): n is a, c, g or t.
  misc_feature (382)..(382): n is a, c, g or t.
ttcttaattcaggaagagttttctttttagaaaaaaatactttaatcaggctttcaacaacattatccatgggtcagtggctgatactattattcctatttttcaggaggtggctggtctctccttgatttttgtttttgtttttgtttttgttttaaggttttagactgattgctatttgggcattaaaggagccataataaataatccatgcccactttaggttatctggtagatccacagaaattttaaatagggagggagagttagggtaaggancgacactatcaatgaccattttaggaactggggggggaaaaaatccccacaacaaccctggaaatgtcttctgtcattacagtttcaaaaacnaggggggggnaaaaaaggagggccactacttttacccgggggtcccctagt

SEQ ID NO: 1144 - DNA, 507 bp, Homo sapiens
  misc_feature (489)..(489): n is a, c, g or t.
  misc_feature (503)..(503): n is a, c, g or t.
tgttatttatttatttatttatttatttatttatttatttatttatagagacaagggcttgccatgttacccaggctggtcttgaactcttgagctcgagcgatccccacctcccaaagtgctgggcttacaggtgtaagccatcatgtccagccgttcagatattctagttgaattggagttggtgggctagtacaccttctaaattaaatgagtaaaggatttagaatggtgcctgacacacagtaggtgctacattcatgttagctactattataaacctttcctgcctctgactttcagggtcttgcccaccaccagcgatgcccagcccttggtagagcttgaaccaccttctataaacaggatggcggtggagagacaggcccagtccctgagcccatgaggagtgtggccccttcaggcccaaagatggtgaacatcactgcagacaactcctcgatgagctgtaccatcgaccataccatncaccagacgctggncccg

SEQ ID NO: 1145 - DNA, 321 bp, Homo sapiens
tttttttttttttttttcaggttatgctgatatatttatctatgtccaaagctatttttgtggcccaccacacagtatgtcttgctatcaggcccaattctgagctaaagtacaacgttattacagaggagtttgccacaaatataaaatcatgtattttaaagcagacagagttagttttcaatatagtacgagtatttattagtaatttaggtatttgcatattagttaacttattgctttggcttattcttttcaatgaattgttaaaatgttatacaataaaatgctctgataaattatattaaatagttatgttaa

SEQ ID NO: 1146 - DNA, 533 bp, Homo sapiens
tttgtattaagattttaatagagagataatcatgggattggacaaaatccaagccactatgatgaaacacttaaaactcggaaagaatacattaacattgagagagaaagttggaaatcaaatagaacgatgagtggttgggaggaaagcaatgctgaatggaattccaaaatattgaccttagtcattatcacatctacttctagctacctctttttggaaagggatggtctggggatacattagaagccacatgttagaagtcaaaacaaaatagaattaaatacatatctttattgactaaaagggacatcatagtcttatcatattgtgggatatgtatgcagatttgtagaatgaaactgaacactaagaagctgtagggctaccagggatagaatcaagttgatggtgaatgaggcagtaaacaaggcaccagagcaacaaccctaagaaagaatatctggaattcatcaggataaaaaataagacttggcaatagcttagacgtgaaggaagtgctcacccaattt

SEQ ID NO: 1147 - DNA, 367 bp, Homo sapiens
tttggccatgtagtcttttatttgtgtgtgggtgtgtgtcatcccattaacatccctcagaggaactccgatccacacttcgggaagggctgatacagaagaatgggccaaagtgcgattttcagttctcagggagcatcttgcagacgtcaggggtcttccgtgttgccctctccccacccagcatgccacattagcctctggttggacccctgcagttctttggccaaacacctcaagccgttctctgcagctcgactccaagctctgcccttgcctggccccaagtggtggaaggatgtggggaggaaacttacaggggcagggacgtttgaaggacatgtaatccttggagcagaacagcgga

SEQ ID NO: 1148 - DNA, 2609 bp, Homo sapiens
ggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccac

SEQ ID NO: 1149 - DNA, 434 bp, Homo sapiens
  misc_feature (92)..(92): n is a, c, g or t.
  misc_feature (308)..(308): n is a, c, g or t.
  misc_feature (410)..(410): n is a, c, g or t.
  misc_feature (415)..(415): n is a, c, g or t.
  misc_feature (433)..(433): n is a, c, g or t.
gtggggaaaaagggtgtttattaaccaacggcagggggaggagctgagcccaggctccccactctgtcacatgcctgtcccacccacctggntgtaagtgggggcattcctaaagaagtgtagccattctcacaataaatacattcattgtggggtggaggtgggagaggttgggtgaagggcagtaaaaacccgtgggattccacgttctcagctacaaaaataacagtcatcctcacccgaggggaatgggggagctcagtcagaattgattgtcccatataggcctagagacttcagaggccccngcccctgaaagtgccccggtgaggtagggacaggggtagggagctaagcgttccaaactcccagcctctgcccttttgcatagtttccaagaatggggtttnatgtngccagtttgagacatcang

SEQ ID NO: 1150 - DNA, 335 bp, Homo sapiens
tttgaaacattgaaatttatttttttccatatgaaaatccattattttctgtgcatcctgaggcacaaataaaaaggtgtatcttttataattttgttgaaatttgaaaatactatctttggggttttctaatttcttgcgcaattgtttttccaaaagttaagtgggaaaaagggatttaaggagggagggagagagaaaaggagggagggagagaaggagagatggattttgcttttcttctttgatcagcagaaaaaaatgtgactgctagcaacagcttttaggagaggggaacaggaatctagatgtgcagaagccaggagggcatatgt

SEQ ID NO: 1151 - DNA, 286 bp, Homo sapiens
ttttacaaagtagtatcttgtatttaaaagaacatgtgttaacaaagcatttaaccatcattatctacagtatatattaaacacaatttattacactctaagttatttaaacatgtgtatttaaaagttgacattactccaaaagaaggcacatgaaaaaaactcatagtttaaacattttcacataagtaaagatagaacagggtagaatgactccttaaaaaaaaaaaatgaaataacaccaagttaatatctcatcatacacaaaagaaaaatacttgactat

SEQ ID NO: 1152 - DNA, 6008 bp, Homo sapiens
tgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgaaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagttgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggcgtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggctaaggtgaaggagatgaacgagaggctggaggatgaggaggagatgaatgctgagctcactgccaagaagcgcaagttggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggagtccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 1153 - DNA, 464 bp, Homo sapiens
  misc_feature (352)..(352): n is a, c, g or t.
  misc_feature (464)..(464): n is a, c, g or t.
tttctagaatttccatttattttccttctctttaaacagtcttttattcctgaggagtttgctcatcttcctaactgcatcctctactgatttaaacatttaatagaattttgtatcccagactcaggaccatgtcatttctcttgagggttatggaagtaagagttcaacatactacctctctgctattcaataaccttacaatgatgctgttacaaaaatctggcatgagacaatcctgtcccattctgctacctgctgtccaagccacctcctagcagctctggcttgccttgtcttattatcatcagacagtctggatcctggctgtttctggcccaccttccatttngcttgcttactttttttagaaaggtagaagaatatccctggagatttttgtctacattttatgagaccaatgatgcctccaaccaataatgtcctactcatggtctacttgn

SEQ ID NO: 1154 - DNA, 3674 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgtttt

SEQ ID NO: 1155 - DNA, 432 bp, Homo sapiens
  misc_feature (251)..(251): n is a, c, g or t.
tttttttttttttttttttttttttttttttgcctctttttgtctcctttaattgatgggggtttttttctctttgtttttgttcattaatcattgggaaaaatacagaaaccaaaaccaatatggctggtttctttcccacacccctccaccctgttcaggatagtcatttgttctcacaaccggcagaggcagaagagggttggaatgaaaactccgaaggccaccaggatgggaaacatgaggctgcntgttgtccgaggcttagggtgtggggttgtgccggggggcctgactgccccccgttcttaatgggcctgttttttttgggaatagacccttcatcataattcttcttcttcttcttcccccttttttctttctccatcccgggtgaggctgaaagtttgggacattatccctcgccccacc

SEQ ID NO: 1156 - DNA, 442 bp, Homo sapiens
ctgaacaaaaatattagagttacaatattactatattccaggccttgctagaaactggggataaatctatgaatatggtcgcttccctggaagacctcacagtccagggaagccaaaccctgcagacatgcagtagacttagtggtctctcttaaggttgcttgttgagttttgacattggagattatgtacagacttgaatgactagttagcctcaggcacagcattctgttgctgggggaatcagctgccctcctcaggcctgggccaagtacacttagagatcgccctcgtcacctctcccatcctttgctgatgcctctgttctagtaacctctgactcagcttcgcctttagagatactcatgctttctggcaacagaggtccttcaaacccaattcctattaaactccatcacttaccagcctctttcagggacag

SEQ ID NO: 1157 - DNA, 4675 bp, Homo sapiens
gctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacttgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatgacgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaatccttgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagatgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcatacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttaaaaaaaaaaaaaaaaaaaaaaaaaaaaaaaaaaaaaaaaaaaaaaa

SEQ ID NO: 1158 - DNA, 473 bp, Homo sapiens
ttttggtctagatggcattggtcagcatcatgcacactgtatattcacaaaatgaggtcctcagggtgaccttgagtgagtgctgtgggtgttactgaaaattaaattgtactgattttttaaaggtaatgcatgttcttggtgcagaattataaaaggacaaaagagagtgtccagtgaagagtaagtcttactcttacccctgccttctactggcatggttgtttacgaagaaaccacgtagcctttctgcaggcatttccgctattcagatacatccctggccatgaacaaggtataagtggacccccatccccttagcacacaaaactacaaagacctcacttggggtggattgaagtggccgctctcagtggtgacaaatactaacacacattccttctttttctacctggtttctatcttcacctacccaagtcctccacccacccaagttcaagcgcagtctcctc

SEQ ID NO: 1159 - DNA, 461 bp, Homo sapiens
  misc_feature (133)..(133): n is a, c, g or t.
  misc_feature (209)..(209): n is a, c, g or t.
  misc_feature (213)..(213): n is a, c, g or t.
  misc_feature (215)..(215): n is a, c, g or t.
  misc_feature (221)..(221): n is a, c, g or t.
  misc_feature (229)..(229): n is a, c, g or t.
  misc_feature (232)..(233): n is a, c, g or t.
  misc_feature (238)..(238): n is a, c, g or t.
  misc_feature (240)..(243): n is a, c, g or t.
  misc_feature (247)..(247): n is a, c, g or t.
  misc_feature (254)..(254): n is a, c, g or t.
  misc_feature (259)..(260): n is a, c, g or t.
  misc_feature (266)..(266): n is a, c, g or t.
  misc_feature (278)..(278): n is a, c, g or t.
  misc_feature (283)..(283): n is a, c, g or t.
  misc_feature (285)..(286): n is a, c, g or t.
  misc_feature (289)..(289): n is a, c, g or t.
  misc_feature (301)..(302): n is a, c, g or t.
  misc_feature (337)..(337): n is a, c, g or t.
  misc_feature (342)..(342): n is a, c, g or t.
  misc_feature (433)..(433): n is a, c, g or t.
gaggccgggcaggatccggcggcggggtctgggcagggagaggccgccgcaacagtcaccgaggtggggtggggaagagaggttcgccgcggcttcgaggcctgcgccctggccagtggcagccacagcgggnccccccgtgtctgcagggcagagggcgcacagtccggggccccctagctcatctccccatctcacccgccggcctngaangntttttngggatagngcnnccctntnnnngttnttctttngaagnntttttntgccgggccggnaattnannganttaacaaaattnnagttcaaattaggttttacaaattttaaaaaaagnaagcnttgacaaccactttaacctgttaaaaggatactacaaggagtggcagagaattcctcaattcttctgcttctgtgctgccagggctaaaanctgcttgaacctcgtgccgaattcttgg

SEQ ID NO: 1160 - DNA, 520 bp, Homo sapiens
  misc_feature (5)..(5): n is a, c, g or t.
  misc_feature (267)..(267): n is a, c, g or t.
  misc_feature (269)..(269): n is a, c, g or t.
  misc_feature (290)..(290): n is a, c, g or t.
  misc_feature (314)..(314): n is a, c, g or t.
  misc_feature (328)..(328): n is a, c, g or t.
  misc_feature (378)..(378): n is a, c, g or t.
  misc_feature (509)..(509): n is a, c, g or t.
ttttnaatcaaaaataaaaataaaattcatttattgaaaagaaaaagcttaacatacgatccatgtgcaaaccccaaaacaggatctacgaactctggcatgatccacatcgctacacataccatgctggaagtgcacatccacacaggcacgtaacatacacagtactgtctagttatcaacacctacagattgggttgatttttcttcacacaccattgacatgttttacaataggaggttacccaattttattatccactgaangnggcataggcttcccccaggantcacttttggattttaaacccaantaacacaggtggantgacagggggcacccctgggcaccctattatcctggcttaccccttcccnttacttctggggataaccctccctaccagggcaccatttatggtcctctggggcaggggggggggacgggctcggtgggggggcacaggggggaaggggggagggggattgttacggggggctgatggttntcggggggggg

SEQ ID NO: 1161 - DNA, 687 bp, Homo sapiens
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaactaattg

SEQ ID NO: 1162 - DNA, 428 bp, Homo sapiens
  misc_feature (352)..(352): n is a, c, g or t.
aggcaatgtttataaacttgtttttatttactaaatgccaactgatgcaccacttagtcctgaaagctctgaagacagaagcagttttttacctcctcaaatatacataggtgcattttatttgcaactggttacttttttatgtggcattctagttattaggtataaattacagtctgtgtagattatctcctttataagacttgaaatttctagaggaaatattgccatattcatatatgcaccatgcttccagccaggagcttatgaataataggtataataataagtaattcaatcagtatttatttaatggaacaaaaagcactttcttaccaaactcatatcaatntttaagttggtctcctttggtttcccccaatttctccaacttttcaatgcctcactaaattgaattgcataaaaca

SEQ ID NO: 1163 - DNA, 392 bp, Homo sapiens
  misc_feature (343)..(343): n is a, c, g or t.
  misc_feature (369)..(369): n is a, c, g or t.
  misc_feature (380)..(380): n is a, c, g or t.
gagccacatggtgctgcaactgaggttcataaacactaagaagcaggaggagaaaagatataatcacgttccagatttaaaatgccagaaaatcttacaacattcaggagcaaatgtgtcaacaaccaatactaagattttcaaagtgaagagcatttaagtttcagttcatatttaaatagtaaatgaatagctttcccccaatcatctctttatatttaaaaaaaaatcaaataacagtctccactaaaactgtggtacgtgtggcattaaaactgtattcattacaaatggccttaaaactggtatatatggtacattaaaaaacggcattaaggttacnatgggatggaaacggtaacacaggcnacaaatgggcntaggaatggggg

SEQ ID NO: 1164 - DNA, 421 bp, Homo sapiens
  misc_feature (315)..(315): n is a, c, g or t.
acactcgtatatatatttttattgttaacacagttcacaattgcaaagatacagaatcaaccaaagtgcccatagaccaatgagtggataaagaaaatgtggtatatatgcaccatggaatactactcagccataaaaaataaaagatgaaataatgtcttttgcagcatcttggatggagctggaggccattattctaagtaaagtaactccggaatagaaaatcaaattctgtatgttctcaactgtaagtgggagctaagctatggatacacaagggtatacagagtgatataatggactatggagactcanaaggggaaggaataaaaaactatatattgggtacaatgcacactattctggtgacaggtgcactaaaatttcagacttcaccactatacaattcatccatgcaacc

SEQ ID NO: 1165 - DNA, 550 bp, Homo sapiens
  misc_feature (284)..(284): n is a, c, g or t.
  misc_feature (360)..(360): n is a, c, g or t.
  misc_feature (368)..(368): n is a, c, g or t.
  misc_feature (409)..(409): n is a, c, g or t.
  misc_feature (419)..(419): n is a, c, g or t.
  misc_feature (441)..(441): n is a, c, g or t.
  misc_feature (503)..(503): n is a, c, g or t.
  misc_feature (515)..(515): n is a, c, g or t.
  misc_feature (534)..(534): n is a, c, g or t.
catcgtttttgtttttatttttcccctttcaacctggttttcggctctggaagctgttcctgtgcacagttctatttcctacagttctgagaaagcggttccatcgcagatgaccaaaggctggacccctctggctataacgtagaccttccagtgggtggtgtcgacatagccgatatcccctggctctattggcatggccacagactgacaatgtcttcggcactggaagggagggatgagctgcaacatggcctcaccgctgccaatgataaataggtcanggcatcttatgcatcttactccccacaacaggttctgggtgaagaaaggagcacttgtttaaagaggcatcttttnggaaatgncaggtgagtgaaaacaggaaaaagctcacgtaacatttgtnatctgttcanaggtctcctccatggataaggnaatgggaaccaccgctcaggaaagcagcgccaccacttgtcgaaaaaacctttcaggagaangccttctgtcgnctcaggggtactggcacanaaaaatgctgaatctc

SEQ ID NO: 1166 - DNA, 379 bp, Homo sapiens
aggtctactgctttcctttccaggaaaatgttatgatttatcaccttaaaaaaaaaagaagaagagaactcgcactgcagacgttaggtgttgctacttggaaccctgaaaaaaaattacctaagaagatgcctttatatttttgctacagaaagaatttggtagaactgtaaagcttggagcaatctctgaacacagttagggttgggttggctctcctgtcagaatgaaggccagtgcggtcggtgcccaggagttattgatgcccaacgctgtctggcttctttgcagctcctctctcctgctctctggcactgcaccatcttcagatgactcaggtttcaccatgactacaccataaaagcagggaactgccaga

SEQ ID NO: 1167 - DNA, 478 bp, Homo sapiens
gagagggtcccagcaaaggctatatgctgtagtagcaaaacgtcaatgtgtgtatgtgctgtgtcgggaggggcagggttctgggcctttccagtcacagtgaagagcttacactaaagcaaagaggggtgataaacagatgcttctccagcatactccagcccaatgctgccccacgcaaatacaatgtgagcttcaaatgtgagccccgtatgtaaagttaaattttccaacagtacatttaaaaagtaaaaagaaatgggtaaaattcattttaataatatatttgattcaacccaatatacccaaactactatttcagtatgtaaccattaaaaaaaaaagattttacctttttctgtactaactcttcaacatcagtattttacactcaacagcacagctcaatttgaacaaatcccattcagtgctcaacagccctaggtgactaatggctatgatgtgggacaacacaatc

SEQ ID NO: 1168 - DNA, 394 bp, Homo sapiens
  misc_feature (327)..(327): n is a, c, g or t.
  misc_feature (347)..(347): n is a, c, g or t.
gcagcggtgcgcgccgccgccctccacacacgtgccgccgttagcgcaggcgcggcccgcgcagtcgtccaggtcgtgctcgcagcgaggacccgcgaagccggcgcggcagcggcagcgcagggcgtggcccaggtccaggcagagtccgccattgcggcatggctgcaggctgcaccggtccaccctcttctcacagttggagccttggaaaccaggtgggcagtggcagatgtaggcagagtcagggtctgcacccccgacacacaagccgccgttgaagcagggtccatctgcacatgtcaccccgctcacctcacaccgcangcccgtagaacccacgcggncaggtgcattcaaggacctggggtgtctcactacagctgcctccatt

SEQ ID NO: 1169 - DNA, 400 bp, Homo sapiens
ttttggagatggagtctcactctgtcacccaggctggagtgcaatggcgtgatctaggctcactgcaacctccgcctcccaggttcgagcaatcctcctgcctcagcctcccaagtagctgggactacaggcacacgccgccacgcctggctagtgtttgctcttaaatacacaaaatgcactgaaccagcaaaaacaaagtcccaggtctgaggagctctgaggatgatgcctgtgatggcctctgcagcatcgtccaggatactgagagagcaggtcaggggaggccttctccaggctgggcagtgggaaggcctctggaccgggggagtgagtattcaggggacaaaggcactacccgggtctggagccgccacggagccagggcacagcctagttt

SEQ ID NO: 1170 - DNA, 356 bp, Homo sapiens
  misc_feature (296)..(296): n is a, c, g or t.
  misc_feature (337)..(337): n is a, c, g or t.
  misc_feature (348)..(348): n is a, c, g or t.
tcagataaacatgtttattgtagatttttcatacacattttatgtacctattattacaaaaaagcttataatctgatggtagtagactgattgcttacttgaaaatattaacttcatacatatcaaaatacaccatcctcaactatataattggactgcaaaatgcttgatatgaaggtatgtaaaaaaataaggcaggtttattataccttacaaccttataaaggggttggctatctaggtacaaaggataacatttatcttataacaaaaatttggataggttttaagggttnggtattgtgtggggggattttccccaagggctaaggggggntaactcggggnaaaaggtt

SEQ ID NO: 1171 - DNA, 339 bp, Homo sapiens
  misc_feature (16)..(25): n is a, c, g or t.
tttttttttttttttnnnnnnnnnntttttttttttttttcccctcccatttttggggggaatatattttatttttacatgggctacaaaaacaaaaaacagttactttttttgccttacatagccaaatccctttgggggcaattaaaaagagggaaagccctcggatctgggtttttttctttctccataaaaaaaaggttcttgggaaaaatgcctgattttaggacgggggcaaaaaatccacaaaataggcctaaaattttttatggggccggaaaataaaaaggcgcctgctccccttgaaaaaaaaaccccacaaaattagggttttttcaa

SEQ ID NO: 1172 - DNA, 430 bp, Homo sapiens
acttttcataaatttatttatgaaattaaatgtggtttctggcttggagaaggaatagtgcaagagtgactgtccatgctgctgaatcctgtgggctccacgccagctcgccaggccctggctctgctcctggcgccccttggcaggacagggcgccatctccacacacccgctgcctgggctgtgggtcagtcctgtgtgctgagccacagaattcggtctctctcttatggcttctcacgctcacgagcgtaaggcaatcttctgtgtcactaagaatcaattctttttctccattgtttgttgttagaaaaacaagatgccaaaatccaaacaaaaccaggaacgaggtggttctggagctaccgcacagcagcaggcagactgaccacactcccgactgggagtatgcagccgactgcaccgtctt

SEQ ID NO: 1173 - DNA, 432 bp, Homo sapiens
  misc_feature (12)..(12): n is a, c, g or t.
  misc_feature (180)..(180): n is a, c, g or t.
actcatgtatantaaaatttatatccacatatgggttagtagtagtatttgttgaacacaatttttggttttcacacaaatgcaccttttcaaaaatcaattgttccttctcccaacataccccaggctggcaaatgacaaatgaaaataaaatccctgctggaaatagtggtataaaangcattttccattttatgtgcacttttcaacccagagaaaataagaaatttgttttatttttgtgcagtagtttctaaaatataatcggagagatgctaggtaaacatttaactttaggattagctttctcaaaacttttaagcgctgggaatgaaagatttgcttacattctgaagctggtgcagggtatcttttttaagccttctttgggctctcattttcacggaccatctgaggtgacttgggaaacac

SEQ ID NO: 1174 - DNA, 619 bp, Homo sapiens
tacaactcgattctttttaatataagaactcaattagaatacaactcagttctaatataagaactaatacaagaattcataatgtgaaaacttatattacaaacggaaggaaattctgacacatgtataacataggtgaaccttgaaaacattatattaagtgaaagaacataatagatagtgatgaaaagataaatcaatttaaaaatgggcaaaaatatgacagctattcctccaagaatgatatatgaatggccaataaatatataaaaagatgctcaatcattagccattaggaaaacgcaaaccaaaaccacaatgagatatcattttacacttactaggatggttgtacaaaaaacacaaataataccatgtgttggtaagaatgtagagacattggaacccctcatgtattgctggtgggaatgtgtattggtgcagccactttgggaaccagtttggcagtacttcaaaagagtaatcatggagctactataggacccagcaattccactcttatcaatgcacccaagataaatgaaaacatatatccacacaaaaactggcacacatgtgttcatagcagtgttatttataaatagccaaagtatgaaca

SEQ ID NO: 1175 - DNA, 440 bp, Homo sapiens
  misc_feature (303)..(303): n is a, c, g or t.
  misc_feature (313)..(313): n is a, c, g or t.
  misc_feature (385)..(385): n is a, c, g or t.
  misc_feature (392)..(392): n is a, c, g or t.
  misc_feature (399)..(399): n is a, c, g or t.
  misc_feature (423)..(423): n is a, c, g or t.
  misc_feature (428)..(428): n is a, c, g or t.
tgagccaaatatgagtggccatggccgtgacacagacctcaggagggcctgggaacatgtgcccaaggtggtcgaggtacagcttggttttatacattttagggaggaatgaggcatcaatcaaatacatttaagaaatacattggttgagttcagaaaggcaggacaactcgaagcagcgggggtgggtgcttccagggctgtaggtaaatttaaacattttctggttgacaattgggttgagcttagctgaagacctggggatcaatgggaaagggaatgttcagggttaaggataaaggntccgtgggangcccaagtttttatttgtgcagggggaagctctcagccagacttccaggaggaggaggagagagccgggttnttaaacncttttcnttatcccacttttaaaagggggtnccccnggggttctttag

SEQ ID NO: 1176 - DNA, 470 bp, Homo sapiens
cctgtaccactgtcactattctctacagaaaaaaagggaaataaaaatttaaccccataacttacattacctcattgcccatcattaacgtttaaaaccctgcccttattttcctatggatcccctcagaaaaaccacacagcacacacaatgctacctaagaggcttcacagatcaaattcatcatgtatttcatacgtaagaatgttagtctaagaatggagtgacacaaaatattaggggtattgtaactgctaagaaagagtaagatgaagtgatgatgcctccactagggagaggtggccctaaggatccctgtcatccctcatgaacaaagtcattaactcaacccagctttagccaacaggtggaacactgtttaagtctatataacggcttgtctcatgggagagagaacaccggaataggttagactttcttgctatagcaagctcaaattgcctcgtgcc

SEQ ID NO: 1177 - DNA, 438 bp, Homo sapiens
tttttttttaatcacaatatgtcttagtgcaatgatggcatactccagttcagatgtactgtcttgattacctcagatccgacatagctgagaaaactgctctaagagttctgacttcctgggatcagtgtcacagaggatctgagtgagcttcctcgagccattttgggcaggctgaagaagcttgttagtatctatatgcttccaggttggcggggccagcttctgccagttctaccatatgccaactggcgacatacaggagcatgctagtgctaccagctccacatatacacacccacttccacccccaagaggtaccagactgtcggacaacttggccgctagcctatgaaaatgtggaaatgctgaagaaacattagccagcaaagcacatactggcagctgaatcaaatgtttaggttcttcaatgtaccc

SEQ ID NO: 1178 - DNA, 641 bp, Homo sapiens
  misc_feature (471)..(471): n is a, c, g or t.
  misc_feature (547)..(547): n is a, c, g or t.
  misc_feature (563)..(563): n is a, c, g or t.
  misc_feature (572)..(572): n is a, c, g or t.
  misc_feature (587)..(587): n is a, c, g or t.
  misc_feature (622)..(622): n is a, c, g or t.
gggctccagacaccccagagtctctttattgaggttcttagaaggcgagtgcaatctcagcctagggtagctgaaggaggtccagttcgtgtcaagtctgtgttcaggaagtaggtgcagagctgccctttgcctttcaccttgatgacaccccggctgtagcaggtgtagcccagggactgtagggcccatgctgtctcctcagtcacttggattttgccaaggactcctgtactctccatgcggctggccacgttcactgtgttgccccaaatgtcatattgcggcttctgggccccaataactccagctactacgggtccatggttcaaccccactcgcaggcggaagttgttgaatgaatgcttgttgatgacgtccagcttagaccccagggccacggcaaattccaccatagtgccaaggtggctgcagctccgttcagcatcctgttgtgcatcctgtccagangtggcatttaagcctgtggtgccatgtaggtgtgccgatggtcttgattttccacccactgaattgggttggaganagtcatcaaaacagcnattactcantgagcagctcagaantctaggcctcatgattgagttggatcaggtagaancttgaatctggatgagcga

SEQ ID NO: 1179 - DNA, 450 bp, Homo sapiens
  misc_feature (5)..(5): n is a, c, g or t.
  misc_feature (201)..(201): n is a, c, g or t.
  misc_feature (229)..(229): n is a, c, g or t.
  misc_feature (319)..(319): n is a, c, g or t.
  misc_feature (333)..(333): n is a, c, g or t.
  misc_feature (342)..(342): n is a, c, g or t.
  misc_feature (375)..(375): n is a, c, g or t.
  misc_feature (384)..(384): n is a, c, g or t.
  misc_feature (423)..(423): n is a, c, g or t.
  misc_feature (447)..(447): n is a, c, g or t.
ttttnactgaaatgaaatccaacaattttattgtaatgagctgtattttctaaatttctcttttattttcctgttttcatacagtaaagaaaacaaaacgcagcacattcacattttcccgaggaactgtaaagatgatctctacagggataaacgttgtaaagcctgaagctcaatcaactgatgttgggaaactctcanagggagtaaaggcttgatctcaatggtntaggaacatgtactgtaatttaatagaagagatgggtcgtcttaatatttaatgcatttaaaaggccttcccaggtccatgcggaggagntacaggtccaaggncttaaatcnaatttctggaacgggatttttatggcttacctntggggtatnctttgcgggtcctcgggggtttcggcgcccaatattctntctcaatagggccttcaatcgggnttc

SEQ ID NO: 1180 - DNA, 410 bp, Homo sapiens
ttagattacatttcccagtgtttattatagttggttaagactgtaacactaagttctggccagtggtatatgggcagaagtgattatgtcatttctaggcctgttccataaaacctcaacactattttccacagcttcttccttcatctgccagcagatgcagaagatccagtggaggaacctgaggccctcttctaggtgaaaatgagctctccttccacctctacccaacctccattggactaggacctaaagatgttgggatgggagagtctattcatgagctgtacttctttcagcatgtttgcccggttactgctcaatgtgttcatcttaagagccatcacctgaccagaagctcggtgtcgtaccttgaacacttcagaaaagaagccagaccctattttttc

SEQ ID NO: 1181 - DNA, 437 bp, Homo sapiens
gtaaaaccaaaagctttattctctagttattattcagctccaattctaactgatttgaaaataaataatttaaaaaattttcttcctagaaagtaaaatatggcaccataatccaattgggcctcatattttaaatcctgcagaaagcaaacgtggacggcagatagatgataataataggccattactctcaacgcagagaaggtggttggtgtttcttttctccacgttcattcctggaccatttttggtctccttcctatcaaatgttgtctatacgatgtgaaggactttgaaagcagccacagcctgtttttccctttcgtgtctgttctgcagtatttccagcagtgagatttcaggtaaactttcttctttcccagcataggttggatttttttgttcctttgatgcttgatgagtcagatttgatggtt

SEQ ID NO: 1182 - DNA, 463 bp, Homo sapiens
  misc_feature (441)..(441): n is a, c, g or t.
ttgtttttatcttttttttaaaggtgcctctcaaagtgctgggattacaggcgtgacaccagtgcccagaccattttagcctttttcttaccagaaccacactcagcttggggcttaagatggataggctaagaggggaactaagcttgtaactgttgcggagacaggcactccaggtgacagttcacaggccctttcaagtgactggagccatgggatcatttctctccaaggatttgtgagtagaagtgatgtgtgtcatctcccaggtgaacaggttcggccttccctacatgctccaagggtacagtgaagagcagagctacaacagagatggggcctggatccctgaatcactgtatggagcagagtgcaaaccaatattataagcaacagcaacaccaacacaggacaatcgactgtttagtaaataattttttntttttgagtcagggtcttgttc

SEQ ID NO: 1183 - DNA, 269 bp, Homo sapiens
  misc_feature (4)..(4): n is a, c, g or t.
  misc_feature (212)..(212): n is a, c, g or t.
  misc_feature (249)..(249): n is a, c, g or t.
  misc_feature (255)..(255): n is a, c, g or t.
  misc_feature (260)..(260): n is a, c, g or t.
gcgnccgcggctgtggcagggatcgggaaggcagtcgttgggattggtgtcgcagagctcgccctcccagccgctggggcagaagcagcggaaggcgtccacctcatcgatgcatgtgcccccattgcggcagggctggcccaggcagtcgtcaatgttctcatggcagtaggtgccagtaaagccactgtcacagatgcaggaaaagttgncccctggctggcttgacgcagcgtccatgggggccanacacgncggangtggcttgt

SEQ ID NO: 1184 - DNA, 2481 bp, Homo sapiens
gcgtccgcccacgcgtccgctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaaggtacagttcctttcaagaggtaacagcactgggatccaagcagggggatgaaaaactcagcagagaaattcgagaccattttgcaagactgtgcccttctcctcaggaccccctggctcagttcttgaaaaacggtgtcatatttagtcagaggccccacccccaggaagcatggatggggatgaaggcacaggcgtctccaacctcagaggccctttgtggggtcaggacacagagtgggagggagactgatgcaggcctaccagtccctggctttttgtctggggctggaataaagaggtgccttcagctggtgggccgagaggcaggaagcagcctt

SEQ ID NO: 1185 - DNA, 404 bp, Homo sapiens
tttaattctaatactatattttacttaatatatcaaaatgttatttcaacatgtcattaacataaaaattactaatgagctattttgcattttttctttgtactaagtctttgaaatccagtgtgtgttttactcttaaagggcatttcagtttggactagccacataccagtagctcatagctgttgtataagacagtacaggtccaggctatttattttttaagtccagtgcaaacaacctctcattctttgcactttgataacttgaatatttgagcctacaatcttcattcattcattggtcaacagccgctggagtgtttactgtgcacaaagcaccgtgctagaagctttctgggctgcttccaagtgtacacaatggagctcaccactccccactgc

SEQ ID NO: 1186 - DNA, 4173 bp, Homo sapiens
gagctttggagcatcttaaggagctcagctcagtaaacaaactcttgcatttcagccagaaagagcctcttgtaacaagtattcaaaggggagagtttctgcatcttttactttgcagtccactatggtagaaaacttgacattccatagataatgatactgggttttctttccaagatccgacgtttaaaagaaatatgagccattctaagctttaagaagggttcaggaaacacaggaattagtagacagcgctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgggttcggcgcactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcgcccagagcacgccagcccgcccgccgacgaccccgagcgccgcttgtctgcctcgccccccgccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcctccgccctctctgctgccttggggttggcagaacacgtgaaggatccgaggagcgagaggaatgtccatttcttaaactgccttaataactagcctttaacctgtgggagcgggtttgaactggaccctggcttaggggtgactcatttctacgaaagggagaccacatgtgtgcacagggaagaacgctttagacacgagtctgcggccactggtgcagatcggagaatctgcagaggtagctcgaaaccatctgcccaactagcctcaactgacagctgaggaaagcaattagccagagaggcagagacactcgcttaagatcacaggcttagtgtgaggacgagcttgaaatcccagtctcctggcccccaggcagggtctgtcaccatagaatgtcttcctctactggggtcgttctggctttttgttagaaacttggtctgagatgttcttcccctgtccattaccattcgatgttcttttgttcagagcaatgtttcttgtattctgaaactggaaactgaaccagtttgcctttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccaccctaaccacagcgcctctccagacctacctcggaccaaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggagggactcaaagcagcaatgcccctcatagtgtaggctaaggtgagtttggtgcatgcaaactgtgtgtcacccacagagcatggggtaatggtgtgtagacacaggcctctgcagaagcgtggggtggggacactgacagccctatctggtcccaggacattctaccatttctgccactggtgttcagctccttctcttcccccaacactcccaaagatacccacagaagtccagccagtttccaggtagagatccaccattggtcttgggctgcgttcaccctcacaccacacgccttaaatctaatcagcaaactataatttgtcgttaaacctgcaacacattagaaacttatatttaaaaacagaattaactcacatgaccaacttttaaatggaaaatatgtaaataggaagtgtttgggttttgttttttctttaagaaaaagaaatgtacaccactcctcatgtgccattttgtcctcagagggcgcttactttttggtaaagaacaagctgctgccttgaccaggagttcatatataactgttattacagaggaattgttataactactaatgtttttaaaaaatttattaaacattattaaacttgatcaggtcaggccaaataaagttttattggaac

SEQ ID NO: 1187 - DNA, 550 bp, Homo sapiens
tttggtggggagggggtactgaacattccctttgttgaatatatttctaatattttccattaaacaatgaacttttttttgcacgtataccttttcttatatctctggtatttctttttttagggtagacacttagcaatggttgtcagttctttaaaaggctattttctcgagtagttgttacttattaagcttaccacaaatcaatcttgtgtttcttatttaatgagaattagttattatccccattttatggatgaggagcctgagacccagaggttcccaggccacccagccagcaagtggcagagcttttccaggcatgcatctcctccagtgcatcacgtcggaagaacttgcagtctccacttaagatctatttctgtccagcaaataagcctagtgcttgggggtgccaagagaagaaaaacaaaaacaaaacctgaaaccactcacaaatccccactctctagatctccagagtcttcctcattctttgtccagaagcttctattcctacaacatcctctctcaacatgattcagtttcc

SEQ ID NO: 1188 - DNA, 2136 bp, Homo sapiens
caggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggagcgtcctggagggcttccgggtgacgctcacctcggtcatcgacccctcacgcatcacaccttacctgcggcagtgcaaggtcctgaaccccgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcagcgcaggccccgaccagggcacacccaccggcccggcctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgcaaaaaaaaaaaaaaaaaaaaaaaaaaaaaaaaaaaaaaa

SEQ ID NO: 1189 - DNA, 340 bp, Homo sapiens
ttttttttttaaaggcagagtttattatgagtttatactaatattttaagttcaaatttagttttggagagttggtacttaagtttttaattttatatttgtgtctcttttctctaatgttgcaaatctttgtcactaatgacattaacataattatcatttgcttttggaagcgcacgctagagcttgcatctccagctcttctgatgtcctcttttaaattcctctctctgtaaaccattccagatgggttctttaatctgcaactgaatcctgacagtgtaagctgtgcaggcagaagtgaaggggcttttcattgtttgcacagtgcctgtgtagc

SEQ ID NO: 1190 - DNA, 367 bp, Homo sapiens
  misc_feature (5)..(5): n is a, c, g or t.
  misc_feature (195)..(195): n is a, c, g or t.
  misc_feature (307)..(307): n is a, c, g or t.
  misc_feature (316)..(316): n is a, c, g or t.
ttctnttttttttcccctggagtggaaatatcagcctgtgtttgaatggagacatgaacagcacagcctcgtgctcatgggtagagagtatgggacaaacctgccctagctggttcctggcccagccacttgccagctgtggggtctgtcctgtggataataaatagcagcaccttcctcctgggagcctggcgngatggcagctgtgagacattgagatcgtgactggcacctgggtgaggactctgtaaatggaactcatcctcaccttgtccttcttaggcctggggggtgagaagctgagcgnccagcatgnaaagaccaactgcatttccagctttcttcttttctttgtggacattggcat

SEQ ID NO: 1191 - DNA, 643 bp, Homo sapiens
  misc_feature (567)..(567): n is a, c, g or t.
  misc_feature (583)..(583): n is a, c, g or t.
  misc_feature (635)..(635): n is a, c, g or t.
gctcaccctcagcagctcctcagggaggtccccgccctcgttgatgccgcggttcatggcgatgaaccgttctgccgtgggcttgtcacgcacgttgtggttgtggaggctggtgttgagcatgatgatggcgaatgacagcacgtagcacgtgtctgcaacgagtccggggtgctgggctcagccagaacctccagtggacagtgggaccccgcgtgctgggggcccgcctgcaagaggtgcccggcccacaggtcgtcctcgctcagggaaggcaggtccccaggaacacacgctgggctgtgcccacaggggccgccccctccagagctggaggctgtgcctggcaaggggccaggctgtgggctctgcactgacctgtggactggaagaccccggggttgcacaggcagtagcgagaagcgaaagcctccatcatgcgatcaatcttctgcgcctccccgggcagcctgaagctccataagaactgccttaaggcttgtacaaggttgagatcagcaaactcatggagttcaacaaaggcttgaagaactttaatattaaatncatccctttcacccangtagtccccaatgacggtcttatttaagccttctcctttataaacgaactgngcgacgtc

SEQ ID NO: 1192 - DNA, 453 bp, Homo sapiens
tttaatgtcatacactgtgtattaactgcagagcatacagaaagttatggatgataatattttcttccagagagaaattttctttgctgtgagaagaatattgtagaaggaacatggcatcttaatgcattatgagactcagctgatttgaaactgggcttcagtccttgtgatgtctgatttccatgtttcagccatttcagaatccaaaataaaagcccagagtcttgtgacagattctattttccaacgataatctgcctttaaccatgtctatttcccttgatcctgagtgtatgctcaggatctgtgacaactctgtcgatggagaatgacagaaatccagacatgtgatttttgaggttagatcacaaaaatgccttgtacttctgcttttttaaagtgatattctcagccttaaagcccatgctgtgaggaatcccaaataagaca

SEQ ID NO: 1193 - DNA, 304 bp, Homo sapiens
ttaatttataaagaaaaagaggtttaatggactcacagttccacatggctggggtggcctcacaatcatggcggaaggtgaaggaggagcagaggcaggtcttacatggtggcaggcaagagagcctgtgcagggaaattcctgtttataaaaccatcagaatctcttgggacttattcactatcacaagaacagcatgggaaaacccacccccatgtctcaattacctcccactgggcccctcccagacacctggggattatgggaactacaattcaagatgagatttgggtgggacacagcc

SEQ ID NO: 1194 - DNA, 418 bp, Homo sapiens
tgagggatgaccagggagtgactagattgctgtgatgtaagaatgaacagaagagcaatacaagatgggccaaacctgaagggaccaacactagtgtgaaagataaggcttcaggctataaatcaggggaggttggggtggacctggagagaaaatactcctgttataaaacaaaaaggcccacatatggtaggtgacagcttagttaggaggaccaaggggccactgaaaggggctctgtggggggaaaactgtgagagagggaacatgtgggcagggataaaggcagcctttcactgtgctgactgaaaactgcaaacaagctacggttccttcccctaagtttaaggtccccaccacgtcctcgccaagtctgtacacagatttgaagatgccaaacgtcccaactttccctcgg

SEQ ID NO: 1195 - DNA, 2290 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttggaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatggggtgggtggtagacccaactcatcaggcagcgggtagggcacagggaagagggagggtgtctcacaaccaaccagttcagaatgatacggaacagcatttccctgcagctaatgctttcttggtcactctgtgcccacttcaacgaaaaccaccatgggaaacagaatttcatgcacaatccaaaagactataaatataggattatgatttcatcatgaatattttgagcacacactctaagtttggagctatttcttgatggaagtgaggggattttattttcaggctcaacctactgacagccacatttgacatttatgccggaattc

SEQ ID NO: 1196 - DNA, 572 bp, Homo sapiens
  misc_feature (368)..(368): n is a, c, g or t.
tttttttttttaagaatatatctgcattcccatgtttattgaaacactagtcacaatagccaagatttggaagcaacctaagtgtccaccaacagacaaatcaataaggaaaatgtagtatatatacacaatgaataattatttatccataaaaaagaatgggattctgtcatttgtaacaacatggctgaaactggaggtcatattgttaagtgaaataagccaggcatagaaaggcaaacgttgcatgttttcacctatttctgggagctaaaagttaaaacaattgaattcatagagactaaaaggatggataccggggcctgggaagggtagtgggggttgggagaagtgggatggttaatggnaacaaaaatataattagacagaatgaataagttctagtatttgatatcacaacagtgtgactgtagtcaacaataatatattgtacattttaaaataactaaaagagtgtaattggattatctgtaacacaggaaaggataaatgcttgaggtgatgtataccccagttaccttcatgtgatcattaggcattgcatacctgta

SEQ ID NO: 1197 - DNA, 823 bp, Homo sapiens
gggctgctccacgcttttgccggaggacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgt

SEQ ID NO: 1198 - DNA, 475 bp, Homo sapiens
acaagattacaagaacatatttcctattataccattgttagtactagggattacttgttatttcacctcttagggaccttatttcaaattctaactcgaagcactaggtgaaaataacttattgtcaccctgactctcaaactctcatctccaccaacaatgtcttactgtttgtaatcaccaaaattatctgttttttccggggttgaaattgtagaaagcactcaaaattaggatcatatttcaatgtgtgtaggtgaactaactgccccaaagacctacttaattaaactacatgcccttgttttttaacaaagcatctttaagtctcctggttgggttaagtgaatttgataaccttaaaaaagtcctgtggattgtgtaatttttttctccactgtagaagggttatttcactttcacagatgtactagatgtatcatgttacgctataataaacaatagaaacagatct

SEQ ID NO: 1199 - DNA, 481 bp, Homo sapiens
  misc_feature (66)..(66): n is a, c, g or t.
  misc_feature (69)..(69): n is a, c, g or t.
  misc_feature (417)..(417): n is a, c, g or t.
  misc_feature (425)..(425): n is a, c, g or t.
  misc_feature (444)..(444): n is a, c, g or t.
  misc_feature (479)..(479): n is a, c, g or t.
ttttttaatggtaaagaatggctttattttacatgcaggcaaaccattggcagtttaagccagtgntanagcagagaggtgatggggtcaggtttgtgttctggaaagatgtctggagctgctggatggagaatggattgaacactgcgttgtcccagcatgtgagctgctgcccgtctccctgtccgcttcccattcctgtggagacaggccttgtggggcagtggcatggagcctacggggcagcctacggggcaggctacggggcagcttacggggcaggctatggggcagcctacggggcaggctacggggcaggcccttgcactgcacatcgcacgttgagccacagactcagaaggcttcttcagggtccagggcaggtggggagggatgggggtgactgggagactcctnccccgcancagaggacagtttcatctntttcacttgggggaattcctttttggccttaggantt

SEQ ID NO: 1200 - DNA, 364 bp, Homo sapiens
ttgaaggaaacaaggcgcttgttttctctttgcacaggcagggagggtgttcctgagtgaccttccagaagagttcgaaattataagcctggagtgccgagggaggcctctgccgctgggggtctcgctgtctgctttggggttctggggcctctccttaccccatctggggtcccaggatgggcccaggggtccaggaaccaaggcagcactgcactggtgcccgcacggtccgggagcaggcctccgtagatcaggggtcaggggccccggcatcaggctctggggagtgaggtattggaatctgaggctcaggggtcaggggccccggcgtcaggctctagggagtgagctattggaatct

SEQ ID NO: 1201 - DNA, 444 bp, Homo sapiens
  misc_feature (312)..(312): n is a, c, g or t.
  misc_feature (424)..(424): n is a, c, g or t.
  misc_feature (441)..(441): n is a, c, g or t.
ttttttttcctaagatattgttctgtattacaaaagaagaaattagactcaattgccctattataaatttgctaaaaatacatatatatatatattttatctgaacagaaaaatagactactctgagatgcgtggacattctatgacatagtcgcgcatcagatacttctagagccagaaaaatggcaacagaaaatgcagaggtaactcttatttctgggtgtagccagggactgggtttgggttgcctgggctgagtgacatgaaaggcatttgggatgctgtcctataaggcagtgatagggtgagggnaacatcagctcggggctgggaagcttttccattgtccctgcccggggtcttcagggggagccccttcttcctcctgcccactttggcagcttaccaggaaaaagtccctttncccaaaggaggcatgtnccg

SEQ ID NO: 1202 - DNA, 472 bp, Homo sapiens
  misc_feature (428)..(428): n is a, c, g or t.
ttttttacgcactctcatgtttattgcactatttacaatagctaagctttggaatcaacttaagggtctgtcaacagacgaatgaagaaaatgtggtacatatataatggagtactactcagccataaaaaagaataagatcctgccatttgaaacaacatggatggaactggaggtcattatgttaggtgaaataagccaggcacagaaagataaacatcacatgttctcactaatttgtgggtgctaaaaattaaaacaattgaactcacagaggtagagggtagaaggatggttaccagaggttgggaagggtagtgaggggagaggggagcaggaggtgaagatggttaatgggtacaaaaatatagttatatacaatggaataagatctagtatttgatagcaaaacagagttactatagccnacaataatttattgtacattttccatatccggtatccaaaatat

SEQ ID NO: 1203 - DNA, 412 bp, Homo sapiens
  misc_feature (329)..(329): n is a, c, g or t.
  misc_feature (337)..(337): n is a, c, g or t.
  misc_feature (377)..(377): n is a, c, g or t.
  misc_feature (396)..(396): n is a, c, g or t.
tttttttttttttaccaaagagcaaaatttaatgaaagccagaactgttaagtatggattcctgttgagaaaaatgtcagtctctttcagagttttcccaatgctctatttttaagaaaagtgtagtaaaaatacataatacaagttaacttttttcttgcttgtgttttcctttcatttctccattgatgaaaaagcacatttcgccagagtcttgggaccccctcataggcataggaccctcatttctaggcacaaacaagtctctttttatccgctcatgttacttgtgggggctcagtagctgggagagggcatcttactagggnccaaaggnaaaaaaggtctttgaaggcatgttggatggttaaaggggntattttccaactttttccnagggtggcaggcttcc

SEQ ID NO: 1204 - DNA, 451 bp, Homo sapiens
ccttgccaaactttattgtgattaaaattccagagacagtaccagctccacatacctctagccctgtctttgccctagttcccgagtgtccttcacccccatcttccaaatcatctctggtttcacggggaagaaaaaacctagggctgctgtgaatgtgccctctcaggtccctgagttggccccaggtagagctgtaagagatcaggaagagggcctccctgcctgacggctatgatcctggaggcaacgtgtggagcagaaagagaagtcgaggtagtgaaagggagtcaggccttggagggatgccccacaactccagcagcgtcgagtattgacgatttgcagagtcagggattggagaggtaggggctcccaactgggcagcgagtcggcgctctgcagccagagctctcttctctcggtcactgaaggcggcaaatcgccttgg

SEQ ID NO: 1205 - DNA, 326 bp, Homo sapiens
tttttcactttgatttaggaagtttatttttttctatgacaggtactttttccagcattttctgcttatataatttaacaaaattaaatacctaagttttgatattgaccacacctgttaaactacatatacaatttttaaaaaattgtagtaaatacacataacataaaatttatcctaattcgttataagtgtacagttcagtggcattaaataccttcacattgatgtgctaccatcactaccatctatctacagaactgtttttacacttgagatttttaatttttttgagatttttatttatttacatttttagagatagg

SEQ ID NO: 1206 - DNA, 428 bp, Homo sapiens
  misc_feature (256)..(256): n is a, c, g or t.
  misc_feature (358)..(358): n is a, c, g or t.
  misc_feature (385)..(385): n is a, c, g or t.
  misc_feature (398)..(398): n is a, c, g or t.
  misc_feature (403)..(403): n is a, c, g or t.
  misc_feature (412)..(412): n is a, c, g or t.
  misc_feature (424)..(424): n is a, c, g or t.
tataagagacaaggtcttgctgtgttgttcaggctgtcctcaaattcctgggctcaagcgatcctcctgcctcagcctcccaaaatgctgccattacaggcataggccatcagcgcccagccctattcaccacattttaaagttatcctctctcctgtccatactagctataaaacttgtcacattccaaaaaacaagaaggtgtgttaaaggatctctaagtgggagaactattatgtaaataggtatataagangtttgcaaattatagataccgtaagaggccattctacattcaggttcaagttcacccacagtgccctgacttttcagactcccttggtggagtctccggcgnttcatttctgcttacttttcttccctnactagtgtttccngggtncttctttcnaaacagtgtgtntcta

SEQ ID NO: 1207 - DNA, 1400 bp, Homo sapiens
cggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgatgccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcagtcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgta

SEQ ID NO: 1208 - DNA, 398 bp, Homo sapiens
acggtaggcatctacgaagtccctttggaatcagtcacacttgtgttgattactaaagtgcatctctttcaatggggtatttttaaataagctgtaactttggatggatattactggaggaatggagctgtgatccctgtcaaactgagaaaaacaagggtatgggaagactcctttggctacttagtgctttgtgacttttgaggagactttgcagcacgtaattctaagaaaattgtaggaaacagcaaagaagagccggggtcttcgtgggggaggggagcgaagtctgtgctcatgcagcttcagtaatgtctgacttgatcctaaacactgcggttgaaatgttcctttagaatgatcttgtgcattccacaaaggcataaaatagtaaaatc

SEQ ID NO: 1209 - DNA, 2910 bp, Homo sapiens
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatcatgttctcatgcagcatgaaaagctctcaccagaagccaagtggatgctggcagcacatttcttgtaacttcccaggctgcagaacattggctaaatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctttttttgctttaaaaaaaaaaaaaa

SEQ ID NO: 1210 - DNA, 386 bp, Homo sapiens
  misc_feature (106)..(106): n is a, c, g or t.
  misc_feature (281)..(281): n is a, c, g or t.
  misc_feature (346)..(346): n is a, c, g or t.
  misc_feature (383)..(383): n is a, c, g or t.
tttttggcttaaacaatagaaatttatttcttacagttctggaggctagaagttcagaatcaacgtgctggcccatccagtttctggggagggaccacctcctggnctacagatggccatcttcttgttgtattctccagggaattggctcactcaattatggaggctgagaagtcccacgatctgccatcttcaagctggagaaccaggaaagccagtgaagtagctcagtctgagtccaaaggcctgagagcctggggcaggattcctgggtgcaagtntcagagtcccaagaccagagaacctgggggtccttgatgtcctatgggcagggaaaagaaagttntttcagctccagaagagagagagtgaatctgattttnttc

SEQ ID NO: 1211 - DNA, 211 bp, Homo sapiens
agaacttttttttttttttaaaaaatcatgaatcaatcaaatcagataattgtatgatgcactgaattactcttatgaggcatgggcaagatattcctatttctcaggtgttaaatttattgtttgaaggttaataaacatttcctttaaaggtacttaactaggattggtacattgtaagatcactttcacacctttatgtcgacgcggc

SEQ ID NO: 1212 - DNA, 366 bp, Homo sapiens
  misc_feature (249)..(249): n is a, c, g or t.
  misc_feature (278)..(278): n is a, c, g or t.
  misc_feature (306)..(306): n is a, c, g or t.
  misc_feature (327)..(327): n is a, c, g or t.
  misc_feature (344)..(344): n is a, c, g or t.
ttaaaacataaactcattcaagattaagatacttttgtaagacatgataccagccattttgtctatccccaaagaactgaggctccagggaatttaaccatgctaatgtaatctttttcacattattaactgaagaaaaatgagtgcccttgaaatattttttaagattaggaaacaaaaggcaagtcagaaggaaccgaagcaggatggtaaggtggatgcctaatgatttcccataggaacttaagnttgcctttgtttgatgagagaaatgagcngggagcattgtcgtgggtggagaagggnctttctagtggaatctttccnggggcatttttctgccnaagcattggctaactttctcaa

SEQ ID NO: 1213 - DNA, 403 bp, Homo sapiens
  misc_feature (374)..(374): n is a, c, g or t.
  misc_feature (396)..(396): n is a, c, g or t.
ttttttggaagactgttactgatttgtttaataaatatgatacatacatccaactccttctgtcacacgatttgcttttttctttttccaaatgttacaagtaaaataattaactttatgagtgtttactatgacacaaatttatgacattatacgagattgaaaagtgaataaaattgtacttaccataaaggattgccaggagagacaggggcatgacaagtagtcccactagcatatcagcaatggctagggacattaagaagtaattggtggcattgtgcagtttcttttccatgcttactgccatgatccaagggatgttgccacctattgtcatgattattatgatgacgatggaaagtgtggccagntttgacccccgttgggaattgnaagcgtc

SEQ ID NO: 1214 - DNA, 494 bp, Homo sapiens
  misc_feature (142)..(142): n is a, c, g or t.
  misc_feature (145)..(145): n is a, c, g or t.
  misc_feature (148)..(148): n is a, c, g or t.
  misc_feature (152)..(153): n is a, c, g or t.
  misc_feature (155)..(155): n is a, c, g or t.
  misc_feature (335)..(335): n is a, c, g or t.
  misc_feature (432)..(432): n is a, c, g or t.
  misc_feature (469)..(469): n is a, c, g or t.
  misc_feature (493)..(493): n is a, c, g or t.
gagaagcagggttgagctccctgttggccgtgcatcgacacagtggctcccctggggttgtcttgagtagaactgagcatggctgggctggcccactgctcctggcagagatcatggcggagtggtcagccccgtgccacangangangcanntngggacggcctcttgacagagcaggcaccttggccgggagctggcttaattccagctgttctccaaaggctctgcaggttagcatggcctttttaactccagacttttgtcaaaacatgaagtcagcagcatcacagccccaggcccgagggtgaagcattgggggggtcccaggtgattncatacacatggagccagataagggaagggattgcggggcttgcaggggtctatgttggggtgaaccctgttggctttatttgatctctcggtgtttnaacctcctgaggcaattgtgggaatttagatgtggcncttcggtctgagcccacggtctana

SEQ ID NO: 1215 - DNA, 1243 bp, Homo sapiens
ctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagc

SEQ ID NO: 1216 - DNA, 324 bp, Homo sapiens
gactgcttactgtttattaagtacacattaaaacctaagtggtcatttaaataaaaataacaacgtattattaattttattacatatatgaacataaaatgtatgaaaacaactgcataaaattgggactggcaaaaaaggtatataattgtacagttcttacgcatgaagtagtatattacatctcttgaaaataactgtgtcacagcttgccaggagtaaagaataaaataaaaaaaaaaaaaaaaaactgtggtaagtcaagatgtacctctgctacccctgacacagcaagaccaacccttcctcctccaatacatttat

SEQ ID NO: 1217 - DNA, 574 bp, Homo sapiens
gtaatgtagtaaatagcaatagatataacccacatcagcaaaagctctctggggtcctcaataattttttaatagtatgaaggcgtcctggttccaaaaagtgtgagaaccacttatttaaaagacccattctaaggcacactgagtgaggcagtgatctatcctcccctccctggcagcgagcatggtttcctgctcacccctttctccaggctctctccctagacagccacgatccccgtccttaccctgggggacctgaagaaccatgtggacaccgcagtgctccacatgacaggagtaaaggttgctgctctgaggatcaagctcaattgatgcccacgcctgataggttccatccccactgggaagaatgtctccataatcaatttcttggacaatttcttccccgtttttcatccatgtcatgtaaatttctggggggtaaaagccatgagctttgcagaagagagctgtaacccctggaaaagtttctttgcgatttactctgaccagtgggggctctaggaagaagaagctaaagttaaatcaaagtgccttatgtactgagcat

SEQ ID NO: 1218 - DNA, 383 bp, Homo sapiens
  misc_feature (26)..(26): n is a, c, g or t.
  misc_feature (328)..(328): n is a, c, g or t.
  misc_feature (350)..(350): n is a, c, g or t.
tttttttttatttttaacttttattntaggtttgggggtacatgtggaaggtttgttacataggtaaacacatgtcatagggttttgttgtacatattatttcatcacccaggtattaagctcagtccccagtagttaccttttctgctcctctccctcctaccgttgctcaggtaggccccagcgactattgtttccttctttgtgttcatacattcccaagagttttaaaaatctgttaaacccttattaatatttatcatatttgaaactaaatttttaaaaatgtgtttgttacttaaaaaataaaaataattttattacacgntaacacaaataggcttattttnatggaaaaggcaatggctcttttccaggggcaa

SEQ ID NO: 1219 - DNA, 435 bp, Homo sapiens
tttgggggggcagtatcattttaactagggaggagagggaaggcttcccttaagaggtgatatttcaactcaaggatggtaaagagggaagccacaaagacactcgaaataaaggtttcagggaagggacagacagcaggggtggcggagaggtgggtgcggggcaggagggccatgaaggcgctcgtgtctcctgcgagggctcagggtgctcggcctgtcataaatggacttaggctttgacagagcagtttagctgccctaaagaaacctgggaaggttcccttggcacttgggattgtccgtttccttttctgtctatgtgcgctgtctatgctggacttgagataattctccggagtccgactcaccaggagactcgggtgtcacccagattgaccttcaaggctcatttcttgtcagtccagtacccgt

SEQ ID NO: 1220 - DNA, 495 bp, Homo sapiens
  misc_feature (386)..(386): n is a, c, g or t.
  misc_feature (430)..(430): n is a, c, g or t.
aaaggtaggtcaaaaccagatttacttaaccacagaaatacctataattaagcatgtttcacatgcaaatgagaaatacagaaccatccaaaatgtacactattgttgacatccaagaaatagactggtccattgattcaagactcaaattttgttttaaatctataaaactaaagattactgggatagatgaaaaggcatcttttatgaatttaagccaaggtttaggacctgtaaacaatgaagaaaatggagaattaaaacaggaggatgtgttaccatccatgcttcttcagagaaagcaaactcctctgtctacctttcaagacctaaggaagaaaaaccaaaccaaaacccaaaaaactcagactcttctaccattatgnaatacaagacacggtagggacaggtagcctctaaggcatatggnccaattccattttggtgaggctaaatctttaaatggggatggaagtgacgctcatgtaatgaacc

SEQ ID NO: 1221 - DNA, 1344 bp, Homo sapiens; identical to SEQ ID NO: 202

SEQ ID NO: 1222 - DNA, 422 bp, Homo sapiens
tttttttttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatc

SEQ ID NO: 1223 - DNA, 610 bp, Homo sapiens
  misc_feature (468)..(468): n is a, c, g or t.
  misc_feature (485)..(485): n is a, c, g or t.
  misc_feature (493)..(493): n is a, c, g or t.
  misc_feature (517)..(517): n is a, c, g or t.
  misc_feature (540)..(540): n is a, c, g or t.
  misc_feature (590)..(590): n is a, c, g or t.
  misc_feature (599)..(599): n is a, c, g or t.
tatatttttttcggtttatttctgattatatttggagaggccaattttacatgatagcttcaaaccaaccattgtacattaaccaaattttacacaagccatttgaaaaaagatctaaaaatgtgcttagttattggtattatataacataacatttatcaagcaccaagagtgtgctgagagctgtacagaacaaacatagaaaagacagtccctgccttcaagaatacccattccttcaggatcttgcacataaaatttcaccttacattccacactcttttattcataaggcataaataaggaagtttgttgcatttctcattgttacttaataaatattgaatacccttttccccaattataccaacaattacttgtatctttgcctttaaatacaaattttcatagtacagtatacagtatatactggatttgggtattcacacaattggaccacaatattcntggcagggtgggttatnatatggangcatggttggaatttcaacattcnccaatttttataccacttaacanatccttttaatggtgggcaggcttcctccggtttttccaattccagaaanaaaaaaccnccaccaagggg

SEQ ID NO: 1224 - DNA, 450 bp, Homo sapiens
  misc_feature (166)..(166): n is a, c, g or t.
  misc_feature (258)..(258): n is a, c, g or t.
  misc_feature (332)..(332): n is a, c, g or t.
gagactgcatagggctcggcgtggttcttgtccataagcagctgcacgtgctgctgtagctcctgcacctgctgctcccgcagctcgctgtgtgcgccaggctctcccgctcctgctccagggcctccacccgccggcccagctccgcgatctgccgcactttgtnccgcaccagctccagccggtccttgtcctcagccgccgccagtatgcgctggacgccgcttctcctgctgggcggcctccagtgccttgtgnaggatcttcactaagctccttctgaagactttaactccttggtgagcatcagaacctgttgctccaaggctgcnactttctcctggggcaagttcggttccgtgtgaattccttcagaaaagaatggggaaggtgttgttctggcgcttggctttctgaagcgaaactgatggtcagagaaaggctggggtg

SEQ ID NO: 1225 - DNA, 521 bp, Homo sapiens
  misc_feature (455)..(455): n is a, c, g or t.
tgtgatttaaaattttattgagccatattaaaaaagtaaaaagacacacactcttctcgtgcgacacagaaccgggacccccgtacagaacattttactgttttcccttaatacccaggaaacatgcactaacctggtaaatacctgcttcatggagagtagtctttcaggattcataccctcaggacattgttggggacctactggactgaacaaaggcgggcaacacgggaataaaagacaagagacaacagagtatatttggaagaaggggttaggggcaccttgcctttagtggacaagggccctgagctttacacagccctccgtatttattaggcaaaaagagatagcgagaaagctgggggagggggtgattgtcagtctgccgtttggttcacagtaatcttgcattttttggacaataggcactagattttttaggcagataactntaaggagcccggagctagggagtgatgtctgttagcaaaccttttggtggcagggcagtgtgagtt

SEQ ID NO: 1226 - DNA, 284 bp, Homo sapiens
  misc_feature (77)..(77): n is a, c, g or t.
  misc_feature (245)..(245): n is a, c, g or t.
ttttttttgggtgagcactcaggggtttatctgaacttggaaatgctacagagccaagagtatggggtgggccttgnccagggcgctgcttccctctccttccacctgcaggctcttcctgagcttttctcctggcttctccaggatgtggtcgctctcggtgtccagacaaacccagggaggaaggctcagcgttcctcggggcagtgcagaaaatgtcctgtcactcccagaggccctgggtncttagccccctgctgcccagggcttcccatctgaccaac

SEQ ID NO: 1227 - DNA, 354 bp, Homo sapiens
  misc_feature (346)..(346): n is a, c, g or t.
ttttttttcattttttaaatggctttattaaaggctacaagtataaaatatgactaagttacaagtcgtcagtaagaatttattacttttgaaaatgttaattaaagaaagggagacgcaaagaaagggaggctcttcctgaaatccacacaggggggtgcggctcagacgggtgacagacccccgctgttcccagtagggcagcacccccaaacccagggggccaagggaggggctcccagatgaaacagaggctggttgctgatttcttgggggaacttttgtaaaaatggaagacactgaatccttgaggctggaatcccagggtgcaggaggactggggggngaggtggg

SEQ ID NO: 1228 - DNA, 424 bp, Homo sapiens
tttttttttttttttttgaactatgaaagttgttttattttattgagaaataattaatatgaacaaaatgttgccactccaagtgtatgcaaaaccacccctaataaattaacgtactggtgtatccacttgcacaactaacacgtagagtattcccatcacccctaaaagtgccttcctgcctcctctctggccatctaacgtcccaccccaaagcctccagcaacgagtgacctgcctcctgttatgacagtttcactttgcacattccagaattccttatgaacagaatcacacagtctgcattcttttgtgtcttgcttccacagacagtaacgtttctgagattcatctgtgtgttgggcataccggtagctcgtttctctccactgccacgtggtattgcactgcatgggtatgttaa

SEQ ID NO: 1229 - DNA, 466 bp, Homo sapiens
  misc_feature (244)..(244): n is a, c, g or t.
  misc_feature (344)..(344): n is a, c, g or t.
  misc_feature (358)..(358): n is a, c, g or t.
  misc_feature (374)..(374): n is a, c, g or t.
  misc_feature (418)..(418): n is a, c, g or t.
  misc_feature (430)..(430): n is a, c, g or t.
  misc_feature (436)..(436): n is a, c, g or t.
  misc_feature (451)..(451): n is a, c, g or t.
  misc_feature (456)..(456): n is a, c, g or t.
ttttttaattcatatgccatttattaaatctgtgatctactggaaacaaaaccatcaggacttgtgctggatgtttttctgagcagttacacacaggccactccaattataatatgtctacataaacagatgtatgatatgtgacttaactgtggcacagtcgcttctcacttacgtctctaaatggttcttcagcaagtcgtacacaagcacattgttagactgcttcgcaaagtgcagggcntattctggtgctttgacaaaatattgcagtcagctccacattcaattacgagtcgtacgatgtctgaatttcctcttttacaggccttcatcagtgcagntcaccattgctttntggacatttacaaaanccctgttccaaaagaatagcatgttgttaaaagtctctctgcancatgaatgaggnggtggncgtctctgcgacgtnattcngctttgtgag

SEQ ID NO: 1230 - DNA, 485 bp, Homo sapiens
  misc_feature (37)..(37): n is a, c, g or t.
  misc_feature (102)..(102): n is a, c, g or t.
  misc_feature (396)..(396): n is a, c, g or t.
  misc_feature (425)..(425): n is a, c, g or t.
  misc_feature (444)..(444): n is a, c, g or t.
  misc_feature (457)..(457): n is a, c, g or t.
  misc_feature (472)..(472): n is a, c, g or t.
ttttttttttttttttttttttgagacagagtcttgnctctgtcacccaggctggagtgcaatgatgtgatctcagcttactgcaacctctgcctcccaggntcaagagattcttctgcctcagcctcctgaggagctgggattacagacacgtgctaccatgcccgcctaatttttgtatttttagtacagacagggtttcaccatgttggaccagggctggtctgggaactcctgacctcaaatgatctgcctgcctcagcctttcaaagtgctgggattacagggcatgagctactggggcctgggccagtttcactgtatttttcggaacaatttccaacaggaaaggcacagcagtggacgtttccttactgggtcactgctcccgtgctntgaggcctgggagctgatccaagggaagnttacacattttcccggccntgagcagatgganttttagggttgctantttgggggacttt

SEQ ID NO: 1231 - DNA, 334 bp, Homo sapiens
gaagtgttcttttttatttgtctttttttaggttaaacttacatacaatgatatacacaggtctcaagtggaccatttggtgagttatgacaaatgcatacagccacatgtaccacgtccctaacaagatattgagagcacattttcaataccccagagaatcctcttgtacatcatccagttaatcctttccctccagaggcaagcactattgtgatttttttccaccatggactagttttatggaatggttggcattctgaactccttggctctttgaggtgtctagttgttcaggttgcctattcttacactcctgaactccaggcatgtg

SEQ ID NO: 1232 - DNA, 440 bp, Homo sapiens
  misc_feature (427)..(427): n is a, c, g or t.
tggtttggcatagtttattacaattagtgtgcgcataaaaccatgtaaactctacaaagtaaaccacttcccctccacactaaccagcagctagtctgccatgaccttccagcacccccattattttaacatatatacatttcacaggatgtaataaccacacaaatagggttataatacattcttcagggaaaaaaatttttggtccatattttctattaaaaaaacacacacacttccctctttggcaaaagaggttaaatctcccatagttaactcacaaaagaaactcaaataaaaactactgagcatgaggtacagctgatgtctggactgttctggaattacagacgcctccttgaggggggaaaatccatttcttattaaaatggagatcagtttccaacagttttccatggtccagttngaaaggccccggt

SEQ ID NO: 1233 - DNA, 430 bp, Homo sapiens
ttttgtttttttttttttttttttttttttttcctggaatatatttttttaattggttgatttgcttcgttcaaagtgcttaaaatggaaaatttagtttgaggaggggcaggtttgggggtaggctcagcgggcatagtggccacaagaagatgcccatctcacacctggagacgtccatgagcacctcgaagctggccgtgtggctgcactggcgtacgacatgggtccggttcctggacaggagcttgaagccccgggcagaccaccctcccgtcccactgacactgcgtagagaagggagaagaggcaggggtgagacggttccctccgcccatgtctgttgggggcagtctttgcccggccctggggactcccaggccatcctggccaaaccaaacagcaggtatagtgagtgctgaaagcccgg

SEQ ID NO: 1234 - DNA, 370 bp, Homo sapiens
ggctttttattctaacagcactggggggcccagcctacctgccagacagttcccaggagtgaggctggtctttcctggcagataagacacagttttgttgggtgaatgagcggctcctcccttggtccaggaagagctccccctgcattgggtgatgaaattctgtctttctgaaggccgggcagtgcacagcggcccttcctctctgggaatgccccggctcacacagtccacttcagacacctggtctcctggtgggtccccagacagcgcacagtgcagtaccgggcaccgcagctgacacaggtgtagggggatgggaagccacagacagcacagaaggggcgctggggcgcgatgggggtccgca

SEQ ID NO: 1235 - DNA, 423 bp, Homo sapiens
  misc_feature (371)..(371): n is a, c, g or t.
  misc_feature (394)..(394): n is a, c, g or t.
  misc_feature (404)..(404): n is a, c, g or t.
tttttttttaaataagaaattttactttcaactcactgattttatacttagaggctttaaaattttttagaatatgtgaagaccggaattaaaccattctcaccatatttttccaggactgtttgctaactggcttgtttttacataaagctttaaacatgtctaccatgggtagtaaacaagaaggactatttgaaactataaaacctaccaaacaaagtgccaaatgcattatcactgctttttccttcttttataaggaatcattactatggaactcgtactcgttgggtgcacagagggatgctattttcatactctctttctttgtaaagggtcttctctatagctccggggttccaaagtaacanctgtggcatcttctcctcccggncaacaaggantcatcttggcacatttccc

SEQ ID NO: 1236 - DNA, 465 bp, Homo sapiens
acaaaaacaaatttatctttaattatatcaagatttgtacatataaagacgggttgagtctcaggattcaccgagctccagaaattggcatcctcaagccccaatagctaataaaaaaggtaagatagtaacctatcttacctggccctaaaaactggcatcctcgagccctgacagcggcccatagattggcagacaactgctgagggttctggtgctgtaatatcagttctgttacagttctttctccaagggaacgagctgctcgcatggctcttacacgaccttcttcctccaccagttgacagtttacaagtgtcaccagtttcctttgcattggacggctcagtgcactctggttcaagctagctacacctttacctccacttagtggttttaagtagagtgccaaatcctcaacgcatttctttgcaacctcatagtggtttaattctcacctagatt

SEQ ID NO: 1237 - DNA, 366 bp, Homo sapiens
caatcaacttagaaagtttattttgccaaggttgagcacacactcatgacatgatacagcctcaggaggttctgacaacacgtgctaaaggtggtcggtgcacagcttggttttatacattttggggagacatgagacatcaatcaatacgtgtaaggtgtacactggttcagtctggaaaggcgggacaactcgaagtgggggcttccaggtcataggtagataagagacaaaaggctgcatttttgggggtctttgatcagcctttcactgaatacacaatttacatggagtggggaataaaggaatagtcacactgatgccttagtctggctcagtggatctgcatttttgcataaatagggc

SEQ ID NO: 1238 - DNA, 453 bp, Homo sapiens
tttttttttatttggtggagatggggtttcactacattgctcaggctggtcttaaactcctgtgctcaagtgatcctcctgtctcagcctcccaaagtgctgggattccaggcatgagccacctcaaatggcctcacatttaaaaattggggcagattcacaccagtccagatttcagaaatccccagatatccaagggtggggccacaacaattggcctccttggcaacagtgagcaggagctgagttatgctggccccattcatgccttcaagtatttattgagcacctgctgcataccaggcactggagagcaagacagttaaaaaacctctgccttcccagacactgcacacacttctattagttgcccaggccctgtaagcatctgaatttgcagcctttgtgtagatgggtaagctgagctgcagagagaaacttgggcaagatcac

SEQ ID NO: 1239 - DNA, 343 bp, Homo sapiens
ggtggaattaccctggttcagtagacccccacaggcgagggcagactgttggctggggaataggctactattagctttgctctgagatccatgaaaataacacttgacctctgcaattactgttctcttacagtgaagatctaaaatctgttcctttataattatatgaaaacacattttctcaagggtctggtctactaaggcattaccaagcaacagggtataacttgaggatgtttctttcttttttctcttcccactgagccctgtacttaaatgtaagttttaaaatattataatcaccaatgaatgtgttggaataaaacatgaaaaatgggtttaa

SEQ ID NO: 1240 - DNA, 1043 bp, Homo sapiens
tgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtgaaaatgcaattacaagagccaa

SEQ ID NO: 1241 - DNA, 1072 bp, Homo sapiens
gataggatcaccacggtggtaacctctcacattgtcttctccacaggaggcgtctgacacagtatgatgatgaagatcccatggggcagcatcccagtactgatcttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatggacacagtagggcttggtgaatgctgctgagtgaatgagtaaataaactcttcaaggccaaggaacagtggtctaattcaactctgtgtcccagcactggcacaccagaagtgccatgctcagaaatgttggttacatgaatgaatgaaccatgaatgaatg

SEQ ID NO: 1242 - DNA, 479 bp, Homo sapiens
  misc_feature (160)..(161): n is a, c, g or t.
  misc_feature (432)..(432): n is a, c, g or t.
ggggccgccccgggttgtgagggcgtgcgcgttgggcagccgtgggacctcgggaccgtccgcccccgctctgtgtctgcacctccactgggctgagcctacccgggccctgcagtccagctctggccagggtcgtctgggtccgtgggggcgtcggctnnggtctctgacttgatcctgtgtccagagcagccttggggaacaggcagctggagccgcgtttaaggcctggggtagggtgcctggaaacgtgaagtggtttgaatgacccaggggcttggaggggtggcggccgagaagagcggcggggaaggtcaggtagggggtaggggttgtgtgcacaccgagtctgcatgttttccatcattcgtggcgtgcaggcgtgtacacctgcgtgaactacatgttcacagacgtgtgcacaagtgtgantcggctttgcttggtggacatttggcaaacgacaatggaggcaaaga

SEQ ID NO: 1243 - DNA, 478 bp, Homo sapiens
  misc_feature (301)..(301): n is a, c, g or t.
  misc_feature (342)..(342): n is a, c, g or t.
  misc_feature (375)..(375): n is a, c, g or t.
  misc_feature (416)..(416): n is a, c, g or t.
  misc_feature (437)..(437): n is a, c, g or t.
  misc_feature (457)..(457): n is a, c, g or t.
tttttttttttaaactctttaaacatttaattcttcagcattaatacacacaaatgcggtaacaggggtcaggggggtggtgcgggggcaggtgggttacagcctccactgggatcagggtttcaacagtgttacttataaattatattacatcaattttatttactgatctaggcagccagagggtggaaggatatacaatgtggaggaaacacattcatacgggggtgaggagtgctggcgggagacacggctctttaacatgaaaaatgtataaagtatttaggcaaaagttacaganaacagatccaaacaaggcaagtttatttttgtttaggaaanttccactttcataggggtttgcccgatgtgctncgtgtctgtggaagggggttgcttcccggtcatcttccttncctaacgggaggggaagccgntgctaagtttggggcccctntcacccaggttggctggctcc

SEQ ID NO: 1244 - DNA, 195 bp, Homo sapiens
acttgtcacaagcaaggagagcgctgggaatactctccaaagcggtgtctctgaaggaaagtgacaggagggttttatggggtgatggagaggggagaagagtgcattggtgcatgtaggaaaggggtcccagtggcgcagccgcagtgagtcgtcctgccagcacacaggtcacatgttacggtcatgaagcta

SEQ ID NO: 1245 - DNA, 322 bp, Homo sapiens
ttttttttttttttttttttttttttttttttttttttttttttttttttttttttcaaaaaccaaggtttttttttttttaaacaaggaaaccaccccaacaagggggggccaaccccctattttttaaaattaaccccaggggttaccccaaccaatccccaaaaaaaaccccattacccaagaaacatttttttaaaccctctttaaaggggggggcccgtttaaaggaaaacgggggggggggaaaaaaaaaacccccggcaaccttgccggaaaggggccccaaaaaaaaaacacccaaagggcggggcccccaaat

SEQ ID NO: 1246 - DNA, 3175 bp, Homo sapiens
tgcttaaaaaaacacaacaggattttcgaagaatcctttcttagaaaacaaacaaaaaaaccaaacaaaaacgtactttctccccactagtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagagccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactttcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggcaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacactggggcagctgatacaaattgcagactgtgtaaaaagagagcttaatgataatattgtggtgccacaaataaaatggatttattagaattccatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacctgagatcattcactcatacatctggccgttgatgttggctgggaactcacctggggctgctggcctgaatgcttataggtggcctctccttgtggcctgggctcctcacaacatggtgtctggattcccaggatgagcatcccaggatcgcaagagccacgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaatagaggagtacaggtgaagcaccaagctcaaagcgtggacaggtgtgccgacagaaggaaccagcgtgtatatgagggtatcaaataaaattgctactacttacctacc

SEQ ID NO: 1247 - DNA, 684 bp, Homo sapiens
aggcgggcagcagctgcaggctgaccttgcagcttggcggaatggactggcctcacaacctgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctgaatcacctggcccagaagccaggccagcagcccgagaccatcctccttgcacctttgtgccaagaaaggcctatgaaaagtaaacactgacttttgaaagc

SEQ ID NO: 1248 - DNA, 476 bp, Homo sapiens
  misc_feature (391)..(391): n is a, c, g or t.
  misc_feature (456)..(456): n is a, c, g or t.
  misc_feature (468)..(468): n is a, c, g or t.
ttttttttttaactgattcacagcttcaatgccatttatggacatttaaaatgcacacatatgcagaacaatgctttagcttttcgagcatatgtatcaaaacattaaaattggatgggtgcccctgggaaaaaggaaagtaggcaggggactgggaatgaagggaaagaaataaaactaaaagacaaaaggtttgcatagaccaatattgatgaagtgccacacactgaggagtgtgctgagctgcgtgaggtgcagagggaacctggaaaggagagagcaggagtatagaaaagtacagctcttgggaggctgaaggtcagatagtcaggtagcctggggtcaaatctgagctctgctgcttcccagctctttcaccttggacacgttnttccaagctccctcgcgtttctttttacgttcaaacaaggttacaaggtgttttacacaagcagntagcagatttgntcccgact

SEQ ID NO: 1249 - DNA, 414 bp, Homo sapiens
  misc_feature (269)..(269): n is a, c, g or t.
  misc_feature (385)..(385): n is a, c, g or t.
ttttaaatgttaatagtaacttttatttgaaagttagggagatgaaaatacatttccaaatttttccaaagatatagctaaatgacaaaataaaaacttcactatgggccaggcgcggtgactcacacctgtaatcctagcactttgggaggccgaggcaggtggatcacttgagagcaggagattgagaccagcctggccaacttggtgaaacctatttctactaaaaatacaaaaattagccgggcatgatggcgtatgtttgtaancccagctacttgggacattaaggcagaaggatcgcttgaactcaggagggcagagggttacaggcgaggccagggttcacaccactgcacttccaagcctgggcgactctggtctnccagaaaaaaaaaaacccaaaaaacaaaa

SEQ ID NO: 1250 - DNA, 354 bp, Homo sapiens
  misc_feature (342)..(342): n is a, c, g or t.
tcaacaacagaaatttattttttcacaatactggagtctggaagtccaaaatcaaggtgttggcaggttggtttctcctgaggcctctctccttggtcttcttgatgaatcctcacatggtctttcctttgtgtgtgcaactcctgtgtctctttttgtgctcaaatttccttcttataaggaaaactgtcagactggattagaacccaccctaacggcttcatctgaacttaatcaccccaaagccctgtctccaaatacagtcacattctgaggttacggctgttagggcttcaatataattttgggaggacacaattcagccccataacaaccccctcnccctttctctag

SEQ ID NO: 1251 - DNA, 3682 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttaaaaaaaa

SEQ ID NO: 1252 - DNA, 1695 bp, Homo sapiens
gttgccgctgcgcacctggctcaggtgagctgccccgcccccgcccggcgcgagccccaggtcctggcagcagcccctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctgaaaaaaaaaaaaaaaaaaaaaaaaaaaaaaaaaaaaaaaaaaaaaaaaaaaaaaaa

SEQ ID NO: 1253 - DNA, 1497 bp, Homo sapiens
cggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcctgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaagcatgcaataaataaaactcccttatttgaca

SEQ ID NO: 1254 - DNA, 423 bp, Homo sapiens
gctccgaggaggaccgggacgcctatgggatgcctggggccatggagtgaatgctcacgcacctgcgggggatggggcctcctactctctgaggcgctgctgagcacaagagctgtgaaggaagaaatatccgatacagaacatgcagtaatgtggactgcccaccagaagcaggtgatttccgagcacagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagca

SEQ ID NO: 1255 - DNA, 399 bp, Homo sapiens
  misc_feature (3)..(3): n is a, c, g or t.
  misc_feature (5)..(6): n is a, c, g or t.
  misc_feature (8)..(8): n is a, c, g or t.
ggncnngncttctcccgagccgagcacgaaggtttcagaggaagccgagtcccagcagcagtgggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcag

SEQ ID NO: 1256 - DNA, 530 bp, Homo sapiens
  misc_feature (530)..(530): n is a, c, g or t.
ttcttctcctatttgttacttctcctaagttgtcttccttcttgtgtgttgtgtgtgtttcaccatgcttcctctttttttcttctgctttcccagaagatcttgccagtagaaattaataaggactgtgtactttcagtcattacaattatgtattcagccagtacatttatctggtacaaaaatgaagctctattgcatcacatactctcagcttctttttgtgaatttagattttataaaaaatacattccaaagaggtaatactaagaactgatgatttttttttcttccccctaggagacttctcagttggggtcatactactttctgtctcagcccattttctgctgctataacagaatacaacagactgggtaatttataaagaaaataaatttatttctcacagttgtggagcgtgggaagtcaaagagcacggtgcatgcatatggggagggtcactcatggtgaaaggccaagacagcatgagagacagagaggcaagatgggagccacttcgtgccgan

SEQ ID NO: 1257 - DNA, 396 bp, Homo sapiens
atgggcgccgccattttgtgaggcggcggcggcgcggcggcaggagcccggggtgtgtataatggttgaatagaatgaccccctccagggaatccccggcactgacggttacgtaaggggctgtgcgcaagtgcggcgtttagggaatccgcacagcccgggccacgcagctccgaggcccacatctccacttcccctaagaggaccgatgggggaagggacagctgaccgggtcttcctcgcagcagcctcacccctagtcttccgcggccggcgagcttctccacctccccgggccgggtctccgcccctcacaggcttccgagacactcactggccctgggttgtcaggaacttcctagccacaaccttattccgaccccacttaagagacaa

SEQ ID NO: 1258 - DNA, 381 bp, Homo sapiens
caggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaagcactaaaaaaagaaaaaaaaaa

SEQ ID NO: 1259 - DNA, 428 bp, Homo sapiens
aaattcagatgaaaattttattcactaattctgcatttcacttgagatagccacaaacaaccaacccttccatctgcagaaatgggtaataaaagcacaggtgtcacattaacctttttggctgagattaggtgccattggttttagattccagctttgaggagtctgtctcaataaaaatgtgccgtgttcttgatatgtgccaggctctgtgcaaggttctgggacagacagtgaaatgcactgacagacaaggtctgtcctcagggggctgagagtctagttcctgccctgctatcatgtacagataatcagtaaataggtgctgtgggggatgggagaggttgagagagcttagggtgcatttctaatggagctcacatgattgtcggccaaattcatttctgtgaagctgcagaactcacagc

SEQ ID NO: 1260 - DNA, 513 bp, Homo sapiens
tttttttatattcacaaatggttttatttcagaaagaaattacacattacaaagagacatagttaagagcttacattcacatatggaagtgaatctaagaaagtcaacaattattaatatacaaaaccacatgattaaaaaagacagtaacataatgacagatgggcttgatttagattcatacacaaaataatatcttttgtttaaaaacaaagagatattggtcttaagatagctctttagaaacaagttggtagttccaatgaactttaaaatcaaagcgatcataacagtctttatgtaggctgtatcacacccacactcatccggcagatggaaagaatccatcaattataccttgcagctagataggatgtcttccactaatcttttgtaaacccaggcatcgccttaagccgctgcctcctgatacccgcacatcgggtttttgaagctggcacacttctaatgcaaattgcattgtccctttccaaaatctgactgggtttgaca

SEQ ID NO: 1261 - DNA, 172 bp, Homo sapiens
tttgtttctggaggccagctttactgtgctagaggaagagggtccccacatccggccctggccatcctggtccggtttgctgaagcaacacacttggcctacccactgggtggggcaggaagtctcgagccttcacttggggtgaggaggagggagatcggtcagcagcttt

SEQ ID NO: 1262 - DNA, 475 bp, Homo sapiens
  misc_feature (448)..(448): n is a, c, g or t.
  misc_feature (458)..(458): n is a, c, g or t.
tttttttttcagctgttactttttcttctcctcctatctggtattctttgatacactctgacagcttgttcaaactgaggagcctaagaaggatccacctgacaacctagactcaggaaaagcacatgcgaaaatgccgtttccagccactgtacgatcatcgggcctcggagaatggtgctagtacgtttccaaagtacttcggaggctgcaaaaaaaatgttaacaaacattacctcatttgatacaaccacctgtgggcataggaaaggcaggtgtcttcattttacaggtaagagaggttaatgatgtgatcaagtctatgctattaggaaaaagcccagcatcagggccaaccttcttactattggtctgtgggtgatgtccccacactacactggcctaagtaaataatcttacgtctttttacacaccccctacggtaaantgaaacaccngggctttggtttcattt

SEQ ID NO: 1263 - DNA, 373 bp, Homo sapiens
actgattggaatttttaccattctgtacactctgaattataactaaacaactacatgttactgacaaatttgtgattctttgagtctaaacaacacagaaactagaagatccctttcctagatttatatacttgattttcttataaaaataacttcagttattatgtcaatatttatctgaaaaaggcagccctctgacagtaaactagtaactggaataactacagtatcattataagctacagtaaaacaacctgtaaagtaatttttcctatttgaataataaatagactggacaggagtgaaaaaccaaaactatgaaagaaaaacccaatgtaaataaaggatacaggtcaaaacaaagttcagaagg

SEQ ID NO: 1264 - DNA, 459 bp, Homo sapiens
tttttttttttagattgtgaactgtccttacttcattttattttatagagcttaaaaatgactactgaaagcgaaatgtggcacatgcatacaatggaatattagccttaagaaattctgacacatgctataacatggatgaactgtgagaacattatactcagtgaaataagccagtcacaaaaggacaaatactgaatgattccacttatatgagatagggtagtcaggatcatagagacagaaagtagaatggtgggtgtcaggacaaaaggaaacggagaagttattgtttataataagtacagatttgctgggtgcagtggctcacgcctgtaatcccaacacttcgggaggctgcggcagtggattgcctgaggccaggagttcaagaccagcctggcacaacatggtgaaacccagtctctactaaaaacacaaaaatgagccacgcatggt

SEQ ID NO: 1265 - DNA, 447 bp, Homo sapiens
ggtagagacgggatttcactatgttggccaggctggtctcaaactcctgacctcatgatctgcctaccttggcctctcaaagtgctgggattacaggcgtgacgaccatgcccggccttcttcatttctttctaatgaatattatacaaggaacgtttttgttttcattctagttttccttaatgaatcttagtgggaaattcatgtttctgggaaattttgacaacataaagacttacatatctctggttggggtatgcccagcaccatctggccattaagactgtactaaagtatgggcctcattactctcgatcttgtcagaccacttggctattcgggaattatttcatcaagctgaagatattccctaaaagatcccagtgaagcctgttccctacaattgacaatgttttatattttaaaaatacataaattaataacgtt

SEQ ID NO: 1266 - DNA, 360 bp, Homo sapiens
ggtcgactttttttttttttttcttaaatcttttttaaagtagtactagctcatggaggatttggaaacttacgtagcacaaagaaaggagagagaaaagagtgtgtatgtgtgtttactcagtaaatatttaacaaatgagtgaatcacaattgaattaataattaattcaattaatattagtaatattctttcagactctgcaaacgcatataatcctattttttaaaagagaaatggtataatactgtacgtcatgttttgtagcttgctcttttcacttcagggtttttctcaaacatttccatatgataaacatgatctctattatcatgctagtgttttcatagttttttaatt

SEQ ID NO: 1267 - DNA, 261 bp, Homo sapiens
aaagaaacaaactcatttatatttattttggtacaggggacaggttctgaacaatgtgtaggcccacctaggggaatgtcaagggtgccctaggaggggataggttttgtgacacaaaggaggccctgaaggggcgatggagtgtctgttcttctctttatgtccattttcaaacaagttgtgagtagaggaagtctgcctccaaatctcaccagactctcccaccaggtgtcctgggaactgagtgatgtgggtctcctg

SEQ ID NO: 1268 - DNA, 392 bp, Homo sapiens
tttttttttttttttttttatttgggttaaaaaacacagataaggttttgtatactaacttttcacagaataatataaaactttcaatggttatgatgaaatctttgtaatatcacttaacaaacatggatatgacaaaatgtatagggagcgtatttgttgctgtacacttaggacatttccaattttctgctattgtaagtactactgaaatgtgcacagatgatttcctaaaatttattcttatgataggctgctaggagtgaaattatgatcttaaagaaatgaatgcatttaaggttttattaatattaccagtctgctttctgaaaacaacattataaaagaaatggaaactcttccaccagttctgacgtttgaagcctgttctg

SEQ ID NO: 1269 - DNA, 402 bp, Homo sapiens
attagtgcctgctttttaaaagtttattttacattttaaatacagtatttttctcataaaaaaaaaatccaggaagtgcctaactccatggtttctataccatatgtacatgaaagctgacagagagcctgacaaatgttctggatgtaacagtatgaacacctatgagctgggactacttctgaatcaaaattaaaaaacacaaattaagcactgcttaaggaaaaaaaaatccagtttctgaacaaccaaaagagaacagagttagatatgtacaaaaccaggtattaaaaaacagaaagaaatacagcacacaaaaaactcaaacaacccatatgtagtggaactggtatatactggcagttaatgaaaaccctcctacaagaaagtgatttaggattt

SEQ ID NO: 1270 - DNA, 379 bp, Homo sapiens
cagtttaattccatttattattctttaaggatacatacatggagataaagtgatgaaagacaagaaggctatggtcaacacaaagttcagtacaggggttccctctatcagacagggatagagataggttcaggaaaccgcacacggtacctcaaaggaaaggcaataaggtgggtggtaggcacacaggggtttgtttattgtcattattattactctttatactttagcatatatattatatgtgtatatacatatctatattccattgcatgtatgaaattttttaaaaattcaaatggcttataacaaaaacaaattatgtataatgtctcaaatgggtgaatcacagcctggaggctcttaatttacctccact

SEQ ID NO: 1271 - DNA, 377 bp, Homo sapiens
  misc_feature (320)..(320): n is a, c, g or t.
  misc_feature (353)..(353): n is a, c, g or t.
  misc_feature (363)..(363): n is a, c, g or t.
acttttttgtgacagatttattgaaatatatagttcacgtgcaatgaaatctaccctttgaaagtgtacaatgcattgtttgtaatatatttacagagttgtgcaaccatcactgccatctaatcttagaacatttttatcactcaaaaggaaatcctatactcattagcagtcactccccattcttcctccccaagtccctggcaaccacaaatttgctttctgtctttatggatttgcctgttttggaaatttcatataaatgagttcatacagtatgtggccttttgtgtctggcttcttttacttgccttcaaggntcatctatcttgtagcatgtatcagtactttantcccttttanggaccaaataaata

SEQ ID NO: 1272 - DNA, 380 bp, Homo sapiens
ttccaggtaaagaatcagtctttatttggaggatgatgtaacttaaacagtgactttcatgggtggtgtgggtatatttaaccttttacaatctccctctacatctcagctgagctcaccaaaaggctcactcaatcagacaggtaaacacatttttgactattaaagtgctattccggggcaaagtttttctcagtttcgtttaacagcagcttcgttggaaacaaacaaaaaaagctatctatggaaataggcctggggaatgaaaaaaaaataacaagcctcgtaactactttggaacatgacaaatgtaatgtgacttgtagatatcagccctggtactggtgactgataccaaagtctctgaggtacgtgttcta

SEQ ID NO: 1273 - DNA, 440 bp, Homo sapiens
  misc_feature (368)..(368): n is a, c, g or t.
  misc_feature (382)..(382): n is a, c, g or t.
  misc_feature (394)..(394): n is a, c, g or t.
  misc_feature (404)..(404): n is a, c, g or t.
  misc_feature (413)..(413): n is a, c, g or t.
aggttatttctttttacttcacataagagcataattcaggccttttccatttaataacaaaaacaatctgtacagaaaacccaaaggcaaccacatagcatatgtaaaatgtgcaaatacactttaaaatgcaagttattctatagcatttgcaagatagaatttcactgtaattagggaatctagttcatcctaacttaatagtcttttgcatgtatagacaatgcaattctacaaggcacaactcagcgttgatgctaaagtatgaaacacatcctcaggattatttatttgaaaatattaaaatagcatcgtttattattttttaatgagtcatgaggctcatttctaaaggcttccataaagcnttacactggtaacntatgtgtgggcnggggcaaacngttccccgnacttaaaagggtgagggccaggccccc

SEQ ID NO: 1274 - DNA, 284 bp, Homo sapiens
tttagcattttcttttctctggtttattttataatacagtatctaatatatacaacattccaaatacatgttaatcaactgtttatgttatccgtaagcttccagtcaacagtaggctattagtagttaagtctttggagagtccaaagttatatgaagattttcaactgtgcgaaaggttggcttccctaaccccgtgttgttcaagggtcagctgcatatgattgtatttctgtgaaatgttcagaatgggcaaacacatagagacagaaaatagattagtg

SEQ ID NO: 1275 - DNA, 409 bp, Homo sapiens
  misc_feature (359)..(359): n is a, c, g or t.
  misc_feature (369)..(369): n is a, c, g or t.
  misc_feature (384)..(384): n is a, c, g or t.
atgtctgttagatggctggctggaacaaagatgtgggaataaggaagaaaagaattcctagtctgcttgggaaggcaagactcacacatgttgaaagtattagagactgtgaagagagggcatatcattaagtgctaaattgcaaggtatggactttaaatcctaaaggaattcggagaagacagacctaaaggaaactccttcatcaggggcttgaggtggggagtggggtggaaagggcaaagtcctgctcttatcggaagtaactgggattaaaaatagggagcatgctctacacctgtgtatctacaccagctgcagggcatgggatgggggtggggggtggtagaggataactncggcactacntagtagccaggcagnccccgggatcctttttgccccccct

SEQ ID NO: 1276 - DNA, 397 bp, Homo sapiens
  misc_feature (26)..(26): n is a, c, g or t.
  misc_feature (251)..(251): n is a, c, g or t.
  misc_feature (257)..(257): n is a, c, g or t.
  misc_feature (323)..(323): n is a, c, g or t.
  misc_feature (328)..(328): n is a, c, g or t.
  misc_feature (339)..(339): n is a, c, g or t.
  misc_feature (346)..(346): n is a, c, g or t.
  misc_feature (361)..(361): n is a, c, g or t.
  misc_feature (384)..(384): n is a, c, g or t.
  misc_feature (392)..(392): n is a, c, g or t.
ttttttttacccttctgcaaatgggnctcgtttattcattcaacaaacatttattgaacccataatccatttggtgccagtctccgagtcaggggtggtgacattcaggttaacagtaactaagttctccaaagactgaggcatgttcacatgtttcctcaccccaacactcccctcaccccgaagacccgcctgggctctcagacgacccagccccgaccctcacctccagtgaccagggccacccactncagggnattttaactggcagtgggatgtttgcagtaggatgatgctaagtcactgtgtttgtgggttgaatncgggntccataggccnattcctntgtttcccttagggnaagtttacttggactttcccagnaggccttnagttt

SEQ ID NO: 1277 - DNA, 446 bp, Homo sapiens
ttttcagataataaaaagcaggctttaattcttttttaaaatttagaatagttttagatttgcagaaatgttgcaaagatagtgcagaattcacatacaccacatacctagtttcccctattttaaaaatcttacattagtgtgggacatttatcacaattaatgaaactatattgatattattaactgaagtccatacttattccaatttccttcatttttacctgctgtttccttacaggtgacattcaggaaaccacattccatttagtcaccatgtatccttaggctactccagactgtgacagtttttcagactttccttgtttttgatgactttgacagctttgaggagtactcactaggtattttgcaaaacgtttttcaattgggatcttctgatttttttttgtcatgataaaactgggattattgttttttggagg

SEQ ID NO: 1278 - DNA, 3242 bp, Homo sapiens
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagaaaaaaaaaaaaaaa

SEQ ID NO: 1279 - DNA, 473 bp, Homo sapiens
aggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcc

SEQ ID NO: 1280 - DNA, 353 bp, Homo sapiens
ttggagggcttcccagacatttgattggtttagaattcatttgggtcagtggttgtcccccaggagtgatttctcctcgcaggggacagttggtgatgtctggagagtttgggttgtcaattcggggtgctactggcgtctattgggtagccaccagggatactgctaattatcctacaatgcacaggagagctcccgcctaacaaataagtagtcagcccaaaatgtcatagtgctgagactaagaacccctgtttggattaaatgctgaggtacttatgtacaatttcctctctgttgcttcatttcaccttgggacagtgttggtgaagacaagtactgtaaatattttt

SEQ ID NO: 1281 - DNA, 422 bp, Homo sapiens
ggagagaaactacggaagtatgaggagggtggtatgtgcttcattcaggcctcaagtcttcaacttcagaatgtccacattggagagaagcctcagtaatgtgtgtaataaagtctttactcagttttcatgactacagtctcacctaagcattcacaaaggggagaaacattaaaatatgaggcacatagaaagcagttccttttgagtttgtatcttgtaatttatcacagaatccatgctgatgatacatttcattcagtcagggtcacagtccacattccccaccaggcgctcagagatatggaatacgttcccggtgtgcactgcggtgtgtgtagtcaaggaccaccgcggagtccaacgcttcccgctgaagagtgagattatagacattttcctttggcattggaggagtggag

SEQ ID NO: 1282 - DNA, 383 bp, Homo sapiens
tttaacatttttaaaatctttattatttattttaagatatcctatgtttacaatggtcaagaaaagaggagataaaatacgtagttaaatgtatcgtattttttcatctttaagtagaacttacttttcagttgttgggatgtccatcacaaatataagtatgcacctgtatacttacgcattattatacagtaaattaaaatttacatgcagtgaaacacacagctgtatgttgaatatacaagatacatttggatttggataagtgtatacacccacataaccaccacccagacaaaatatattctgtcatctggaaagtttcccagtattccctttcagttaatctttatccccccagaggaaaccactgttctgatttc

SEQ ID NO: 1283 - DNA, 381 bp, Homo sapiens
gacagtgtgaagaatgtaagtcgaaccttatctccttccttacatttcattgtgtcctcgtttctaacccccagtacttccattttcccagtgttgtcacttaggtcaaataatatgtttttcttcttttctgttaccttctggactacaaacaaaccattcacaattgttccaaggggctgagtttgaagcgtgttgatcttcggggtttcaccagcttttcttcttgggtctcaaacgtgaagggcttctttgctttcagtaccataactggcaaacagcgcttctgaaacccttctctgatagattcctgctgggccaccatctgtttctgttcaggcttaacatgaggagagacttttggtgcagcacgttgctttg

SEQ ID NO: 1284 - DNA, 324 bp, Homo sapiens
  misc_feature (288)..(288): n is a, c, g or t.
ttttgcatttggaaaggatactttatttcttacaaagggttacagcctacaaggtggtcattctgcaggctagaaagcgtaacctccagcaaagaccggaggcaggcacttctagggaaggaagagtaagacagaaatttaaattgaatgggttggccaagtatacatattcaacaggctacaggtggattcatgaatattcatgaaggcagtcctgatgcatgcatgttacaccttggggtggaggcttaacatttaaatgtattacagttaggccctatacatganaaggtgaagcagtaacacgaaggcacacaatgcacc

SEQ ID NO: 1285 - DNA, 2580 bp, Homo sapiens
cctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtg

SEQ ID NO: 1286 - DNA, 477 bp, Homo sapiens
  misc_feature (415)..(415): n is a, c, g or t.
  misc_feature (429)..(430): n is a, c, g or t.
  misc_feature (470)..(470): n is a, c, g or t.
tttcaaggacacactaattttattttgaaatagggactgcaagggcgggctgtattgagaaggatggccccctggtgtgatgagcttggggcctcatctgctcaccgtgcacgccctggagtcctgctacccagcatgtccaaactaagggcacccccctgggaagggatgcagagacggggagcttctctgtatccccttacaggcaggacagggggctggggtgcagaagcactctggggagacctgccctaagctttccaagctgggaggaggggacgatctggggtccagcaggctcccgggctggggtccacttcccgttctccctggggagttggagaccgaccaagcctctctgttgggcaggactgaggggtgggcctgtgtctccagatgttgagcagggcctggncagcccctgagggnnaatcctagagggaggtggtgggtcctggtgactggtattnaatatgt

SEQ ID NO: 1287 - DNA, 467 bp, Homo sapiens
ttttgacttgatatgatttattatttttactacttataagaatggaaataagttctccttagtttttttcttggagaaagtctgacatgtgaggcacagatgagttattaaaggcagatgactttccagccttgtcttaaatgttccattctttaccttagaaattatttaaatttgtgtcttccaaatactgtagtaatattgatgctccaaagagatgtcccacggagattctgctcttgtgtgtccaccctgcaggagctgaggcagtttcttatgacagtttcagaagcgagtagtcgtgcagtacttaatctaaaaaacatggcaaccctcccgcgcaggccataagaggcaaatgaacctttgttggttggcgggaaatcgagaccctggcaagggggcttctcccttggagaactccgagaactgccaggtccgcggccgttaacccgcctctagggacg

SEQ ID NO: 1288 - DNA, 508 bp, Homo sapiens
  misc_feature (466)..(466): n is a, c, g or t.
tttcaggatggttcttttatttcttcttttaacaactatttattggccgtggctgttccagacacacacaagtgaggaactcgccccagtgggtgagcaggcagggacggtgcctaagtccccacatgactgcagcggagtgcagtggatgctaaacgtgggagctggcaggagtgcctgcctccgtgcctcggagctgttggagtgagcatctgggatgcatgttataccttgcctcttcactcagatggaaagttgagcttcaaataaagaggccaactctatgcctcttaagattcttgggaactcatagcgcccattggatcttcagcacgatcccatgggggtatttccgagttgaacttttcactttctgtccattcgggctcagctacctggtgaagctacttgagatctttgttagctgtgtttggtctgtgttttctggacaattactttttagttnttaaatgggtagactacttagaaaccaccaagagctgttact

SEQ ID NO: 1289 - DNA, 331 bp, Homo sapiens
ttttttttttttggttatataaacatttaattacatctccatgcattttgattgtgccgtcttcttttcgtattctggagacagtgttttcctgagtgtcaaactttttggaaggcccccaagaggcctggcctggggcctgtggctggccagccgggcagccaaagctccacccaggttctcagcgagactctgctactgaccggctgagactgggcaggccctgtctctcctaagccctgtctctctgtgggcagggcgaggggttggaggctcttgctgatttggagctgattttcacattcctggcacttcctgggcaccccttagt

SEQ ID NO: 1290 - DNA, 460 bp, Homo sapiens
tttttttattgctcacattattcatactttattaatttattttttaattgacaagtagtaattgtgaacatctatggggtacagtgtcatgttttgatctatgtatacatcgtataaagattaaatcaagtaatgttttgatctatgcatacattgtagaaagattaaatcaagctaattaacatatctatcacctcaccaacttaccttttgtgtgtgtgtgatgagaacattaaaaatccttttttaaagcagttttgaaatatgtaacacattattattaactctggtcactgtgcagtgcgataggtcactaaagcgtattcctcccgcctgagactttgtggcctttgaccaacaccttctccctctccccacagcccctgctataaccacctttctactctgtttctatgagatccacttttttagattctatatataagtgagataatttatt

SEQ ID NO: 1291 - DNA, 458 bp, Homo sapiens
  misc_feature (425)..(425): n is a, c, g or t.
ttttttaaaagactgaggaatttattcttagtttcctcagagtgtaaattcattgttaatcagcctgtgccagggactagataattctgcagatgtgcctggcattgtaagagggcttacactcttcagtgctcgctcttgaacattctctcccacttcattctcagaataatctgtaaggttggtaggatgcaaactgtcatcccatttcctgtggatgaggaaagtgaggcagagtttagcttgtgctttggggaagttactccatggtgaagctaaagctgaatcttggaccttctctggaagaagagggcaagtctgtattgggattatgttattacaatctcaatattagcaacttctgactttagaaaactccagaacagctgcaatgagatgttcattaacaggggaggcactacggngcttcatggaattctagaaactgtctcttcttg

SEQ ID NO: 1292 - DNA, 408 bp, Homo sapiens
  misc_feature (159)..(159): n is a, c, g or t.
  misc_feature (316)..(316): n is a, c, g or t.
  misc_feature (374)..(374): n is a, c, g or t.
  misc_feature (383)..(383): n is a, c, g or t.
  misc_feature (392)..(392): n is a, c, g or t.
  misc_feature (406)..(406): n is a, c, g or t.
attaggaaggggaagtaggataggggacacgattacgttcctaagtgaaggtttcaagctgggctttgcagggggtataattagtatggtcactgtgtcttgtaggatgtttggctccttggtgatagagcttgccaaaatggtgtcctttgataaggngggctggggggcagggagttgaagaaattcccttgccaggctttgggatctgtaaacatttccattaatcaacaagtgtgtactaatcccgagtcttacattgcgatgcctcactatccccacagccccatccctacctctctgcccaccagggttnagctcaaatctgtgtgtttgtgggacctctgcataggccccaaggggagggagacttnagggtcagntggggactnagcagggcaggttnat

SEQ ID NO: 1293 - DNA, 472 bp, Homo sapiens
tggtaagactttattttttagtcagttttagattcacagcaaaattgagaggaatgtaccaagatttcccagatactccttttctccacacatgcataactttcccccattatcaatacccctaccaaagtagtacatttgttacaatcaatgagcccacaatgacatcattattacccaaagtctatagtttacattagagttcagttttgtattgtacattttacgggtttggacaaatgtgtaatgagctgtatccaccattatagtatcacatagaatagttccactgccttcaaagtcctctctgctctgtctattcgccacttcttcccccagccttctcgcaactagtgatcttattactgtctacatagttttttactttcccagaatgtcatatagttgatatcagccttccccaactttgttcttctccttcaatactgtgatagctacctattctaggtct

SEQ ID NO: 1294 - DNA, 408 bp, Homo sapiens
cactaaacatgattctttaacccattcctgtcaacactggcatcgaccaacctcccaaggtccctgctgtacccctcaaaaccattaagcctttgctggactgtgatctaagggcggctggcaaacacagttttgtcggtttccaccactcactctgctgagatcagcttggcctacacgaatgggtcctgtctgctcccatcccttcttacttgtggtaatctcggacacagtagatcttgttctctgagtccacggtgaagggcaccccatccaaacactcattacagatgacacagcggaaacagccggggtggtaggacttccccagggcttgcaggatctggagcagagaccaagactcagtggggattatagggaaggatgagatggtggaaggggaaagga

SEQ ID NO: 1295 - DNA, 738 bp, Homo sapiens
ggccagctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagagcagagcctctagcctcccctggagctccggcctgcccagcaggtcagaagccagagccagcctgctggcctcagctccgggttgggctgagatggctgtgccccaactcccattcacccaccatggacccaataataaacctggccccaccccaaaaaaaaaaaaaaaaaa

SEQ ID NO: 1296 - DNA, 426 bp, Homo sapiens
ttgtttcatatttttaatagatactacatttatatgactcaaacatcaaaactactcagttccccagggccccaacaggaaataaccagtggttgataatttcttttttaatgcagatatttttctacatctacaagccaattcatattatcttccccctctttttgacacatacaggagcgttttacaaacactgctcttcccttgcttgtcttccttagcatgtgttagagagctttctgtttcaatatctagagaacatgctcattcattttacatttgtatggtatcgcacactaggaacaaccatcatttatctaactgtgatgcacatgttggttgtttccagtcttttaccattaccagtcatgctgctgtaggggccaagcttcccacttcctcctctgaaggttcactgacaaaagg

SEQ ID NO: 1297 - DNA, 238 bp, Homo sapiens
tttaatttgtaaaggaaagagtttttattgacttgcagttccacagggctggggaagcctcaggagacttacaatcacggtggaagaagaagcaaacatgtccttcttcacacggtagcagaaaggagaagtgccaagaaatgtcctctgacatgaaaatcggtaaataaattacaatgaacacaatacagccatgaaatgtaccaacgatctctgcatcaggtgctgacataaaaga

selected from a group consisting of SEQ ID NO. 1 to SEQ ID NO. 1297 as well as gene fragments thereof with at least 20-2000 nucleotides.

9. The method according to claim 8, wherein the gene fragments comprise 20-200 nucleotides.

10. The method according to claim 8, wherein the gene fragments comprise 20-80 nucleotides.

11. The method according to claim 1, wherein the gene expression profiles are ascertained by means of hybridizing methods.

12. The method according to claim 11, wherein the hybridizing methods are conducted on microarrays.

13. The method according to claim 1, wherein at least 2 to 100 different genes and/or gene fragments are used.

14. The method according to claim 1, wherein at least 200 different genes and/or gene fragments are used.

15. The method according to claim 1, wherein at least 200 to 500 different genes and/or gene fragments are used.

16. The method according to claim 1, wherein at least 500 to 1000 different genes and/or gene fragments are used.

17. The method according to claim 1, wherein at least 1000 to 2000 different genes and/or gene fragments are used.

18. The method according to claim 1, wherein the gene activity is determined by hybridisation-independent methods, in particular by enzymatic and/or chemical hydrolysis and/or amplification methods, preferably PCR, subsequent quantification of nucleic acids and/or of derivates and/or fragments of same.

19. The method according to claim 1, wherein the sample is selected from the group consisting of body fluids, in particular blood, liquor, urine, ascitic fluid, seminal fluid, saliva, puncture fluid, cell content, or a mixture thereof.

20. The method according to claim 1, wherein cell samples are subjected to lytic treatment in order to free their cell contents.

* * * * *